United States Patent 12,397,048 (BUNYAVIRALES VACCINE) - sequence listing, part 15

SEQ ID NO: 16490 - RNA, 3222 nt, synthetic construct
  misc_feature 1..3222: note = derived and/or modified CDS sequence (opt11) from SFTSV(YG1)__AB817987.1__GP
  source 1..3222: mol_type = other RNA
atgatgaaagtaatatggttcagctcgctcatatgcctggtaatacaatgctcaggcgacaccggaccgatcatatgcgcaggaccaattcacagcaacaagtcagccaacataccacacctcctcgggtactccgagaaaatatgtcagatcgacaggctgattcacgtatcaagctggctacgcaaccacagccaattccaaggatacgtaggacaacgcggaggacgaagccaagtcagctactttcccgccgaaaactcatactccagatggtcaggactgctaagcccatgcgacgcggactggctgggaatgctagtcgttaaaaaggcaaagggatctgacatgattgtgccgggtccctcgtacaaaggtaaggtcttcttcgaacgacccacattcgacggatacgtgggctggggatgcggatcaggcaagagcagaacagaaagcggcgaactctgctcaagcgactccgggacgagctccggcctactaccgtcggacagagtgctttggatcggggacgtcgcgtgccaaccaatgacacccatcccagaagaaaccttcctcgaattaaagagcttctctcaaagcgagttcccagatatatgcaaaatagacggaatcgtattcaatcaatgcgaaagcgaaagcctacctcaaccattcgatgtcgcctggatggacgtcggacacagtcacaaaatcatcatgcgtgaacacaaaacaaaatgggtccaggaaagcagctcaaaagacttcgtatgctacaaagaaggcaccggaccatgctcggaatccgaagagaaaacctgcaaaacatcaggatcctgcagaggcgacatgcaattctgcaaggtagccggatgcgaacacggagaagaaacatccgaagcgaaatgtaggtgcagcctggtgcacaaaccaggtgaggttgtggtcagctacgggggcatgagagtccgcccgaaatgctacgggttctcccgcatgatggcgaccctcgaggtgaacccacctgaacaaagaattgggcaatgcaccggatgccacctggaatgcataaacggtggagtaagactaattacactaactagcgaactgaaaagcgcaactgtctgcgcgtcccacttctgctccagcgcaacgagtggcaagaaaagcacagaaatccaattccactctggcagcttagtaggaaaaacggcaatacacgtaaaaggagcactggtagacggcacagagttcacattcgaaggctcatgcatgttcccagacggatgtgacgccgtagactgcaccttctgccgcgagttcctcaaaaacccacaatgctacccagcaaagaaatggctatttatcataatcgtcatcctcctggggtacgcaggactgatgctcctaacgaacgtactaaaagcgataggaatctggggaagctgggttatagccccggtgaaactaatgtttgcaataataaagaaactgatgagatcagtcagctgcctcatgggaaaactaatggaccgcggccgccaagtcatccacgaagaaataggcgaaaacagagaaggtaatcaagaggatgtacgcatcgaaatggcccgcccgagacgtgttcgacactggatgtactccccagtaatacttgccatactagcaatcgggctcgccgaaggatgtgacgagatggtacatgcggacagcaagctagtatcatgcaaacaaggatccggaaacatgaaagaatgcgtaaccacaggacgagccctcctcccagccgtcaacccgggacaagaagcctgcctccacttcacagcacccggaagcccagactccaaatgcctgaaaataaaagtaaaacgaataaacctcaagtgtaagaaatcatcgtcttacttcgtccccgacgcacgatcccgatgcacgtccgtgcgacgatgtaggtgggcaggcgactgccagtctggctgcccaagccacttcacatcaaactccttctccgacgactgggccgggaaaatggaccgcgccggcctcggcttttcaggctgcagcgacggatgcggcggcgcggcatgcgggtgctttaacgccgctccaagctgcatcttctggcgaaaatgggtggagaacccacacggaataatctggaaagtttcgccctgtgcagcctgggtaccttctgccgtgatagagctgacgatgccaagcggagaggtgcgcacattccatcccatgtccggaatccccacccaagtctttaaaggagtatcggtgacgtacttaggatcggacatggaggtctcaggactaaccgacctgtgcgaaattgaagaactaaaatccaaaaagctcgccctcgccccctgcaaccaggccggaatgggcgtagtagggaaagtcggagaaatacagtgcagctcagaagaaagcgcacgcaccatcaagaaagacggctgcatctggaacgcagacctagtgggcatcgaactccgggtagacgacgcggtgtgctacagcaaaataaccagcgtagaggccgtagccaactactcagccataccgaccacgatcggaggactccggttcgaaaggtcccacgacagccaaggcaaaatatccggctcaccactcgacataaccgccattcgcggatccttctccgtaaactacagagggctacgcctctccctgtccgagataacagccacttgcacaggcgaagtaaccaacgtaagtggctgctactcgtgcatgaccggcgcgaaagtgagcataaagctgcactcaagcaaaaactccacggcgcacgtacgctgcaaaggcgacgaaaccgcgttcagcgtcctcgaaggcgtccactcatacacagtcagcctatcatttgaccacgccgttgtggacgaacaatgccaactaaactgcggaggtcacgaaagccaggtgaccctcaaaggaaacctcatcttcctagatgtccctaaattcgttgacggatcatatatgcaaacataccacagctcagtaccaaccggagccaacatcccatcaccaacagactggctaaacgcactttttggcaatgggctatcacggtggattttaggcgtcataggcgtcctcctaggcggcctggcactgttcttcctcataatgagcttgtttaaactaggtaccaaacaggtctttcgaagcagaactaaactagcctga

SEQ ID NO: 16491 - RNA, 3222 nt, synthetic construct
  misc_feature 1..3222: note = derived and/or modified CDS sequence (opt11) from SFTSV(SDTA_1)__KX641913.1__GP
  source 1..3222: mol_type = other RNA
atgatgaaggttatatggttcagctcgctaatatgcctagtaatccaatgctcaggagacagcggcccgatcatatgtgcgggcccaatacactcgaacaaatccgccggaatcccccacctacttggatacagcgaaaagatctgccaaatagacagactgatccacgtctcatcctggctgcgaaatcactcacaattccaaggatacgtaggacaacgcggaggccgtagtcaggtctcctactatcctgcagaaaactcctacagccgctggagcggactactaagcccttgcgacgccgactggctggggatgctcgtcgtgaaaaaggcacgagaatcagacatgatagtgccaggccccagctacaaaggaaaggttttcttcgaacggccaacctttgatggctacgtgggctggggctgcggatcaggcaaatcaaggacagagtccggagaattgtgcagttcggacagcgggacaagtagcggcctactcccatcggaccgagtactgtggataggagacgtagcatgccaattaatgacgcccataccagaagaaacattcctagaattaaaatcattcagccagtcggagttccctgatatctgcaagattgacggaatcgtgttcaaccaatgcgagggagaatcactaccacagccctttgatgtagcctggatggacgtaggacactcacacaagataataatgagggaacacaaaacgaaatgggtacaggagagcagctcgaaggacttcgtatgctacaaagagggcacaggaccatgctcggaatccgaggaaaaagcatgcaaaaccagcggcagttgccgaggcgacatgcagttctgtaaagtggcagggtgcgagcacggcgaagagacttccgaagcaaaatgcagatgcagtctggtccataaaccaggagaagttgtagtcagctacggaggcatgcgggtacggcccaagtgttacgggttctcgcgcatgatggccacgctggaagtcaatccgcccgagcagcgaataggacaatgcacagggtgccacctagaatgcataaacgggggtgtacggctaataacgctaacatccgagctaaggtcagccacagtgtgcgcaagccacttctgcagcagtgccagctcaggcaagaaaagcaccgagatccactttcacagcggcagtctagtaggaaagacagccattcacgtaaaaggcgccctagtagacgggacagagttcacattcgaagggtcttgtatgttccccgacggctgcgacgccgtggactgcacattctgcagagagttcctgaaaaacccccaatgctacccggccaagaaatggctattcataatcatcgtaattctactaggatacgccggcctcatgctactcacgaacgtgctcaaagccataggcgtctggggaagctgggtaatagcgccggtcaaactcatgttcgctataatcaaaaagctgatgcgcacagtgtcatgcctagttggaaaacttatggacagaggaagacaggtcatccacgaagaaataggagaaaacggcgaaggaaaccaggacgacgtccggatcgaaatcgctagaccacggagagtcagacactggatgtacagccccgtcatactaaccatactagcaataggcctggccgagggatgcgacgagatggtacacgcggactcaaagctcgtaagctgccggcaaggaagcggaaatatgaaggagtgcatcaccacaggcagggccctactaccggccgtaaaccccggccaagaggcttgcctccatttcacagcacccgggagcccggacagcaagtgcctaaaaatcaaagtcaaaagaataaatctcaaatgtaaaaagagcagttcgtatttcgtaccggacgcacgaagccggtgcacatcggtacggaggtgtagatgggcgggagactgtcagagtggctgtcccccacacttcaccagcaacagttttagcgacgactgggcggggaaaatggaccgggcgggactgggattctcaggatgcagcgacggatgcggcggagcagcatgcgggtgcttcaacgctgccccatcgtgcatcttctggaggaaatgggtagaaaacccacatggaataatctggaaagtaagcccctgcgccgcgtgggtgccgagtgccgtcatcgaactaaccatgccgagcggggaagtaagaactttccacccgatgtccggcattccgacacaggtcttcaagggagtaagtgtaacatatctgggttcggacatggaggtatccggactaacagacctatgtgaaatcgaggaactcaaaagcaagaaattagccctcgcaccatgcaaccaggcaggaatgggagtagtaggaaaagtcggagaaatacagtgcagctccgaagagagtgcgcgaacaatcaagaaagatggctgcatctggaacgcggacctggtcggcatcgaattaagggtagacgacgccgtatgctacagcaaaataacaagcgtagaggcagtagcgaactactccgccatacccacaacaataggcggactcaggttcgaacgcagccacgactcacaggggaaaatatcaggcagtccgctggacataacagcaatcagaggaagtttctcggtaaactatagagggctaaggctaagcctaagcgagataacagccacttgcacaggggaagtcacaaacgtatcagggtgctacagctgcatgacaggcgcaaaagtgagcatcaaactccactctagcaaaaattccacagcacacgtccgatgcaaaggtgacgaaacagcgttcagcgtactagaaggcgtccacagctacatcgtgtcgctatcattcgaccacgccgtggtcgacgagcaatgccagcttaactgcggaggacacgaatcacaagtaaccctaaaagggaacctaatcttcctagacgtcccgaagtttgtagacggaagttacatgcaaacctaccacagcacagttccgacaggagcgaacataccgagcccgaccgactggctcaacgcactcttcggaaacggtctgagcagatggatactgggggtgataggggtactactgggaggtctagccctcttcttcctaataatgttcctactgaaactgggaacaaagcaagtgtttagatcccgaaccaagctggcctga

SEQ ID NO: 16492 - RNA, 3222 nt, synthetic construct
  misc_feature 1..3222: note = derived and/or modified CDS sequence (opt11) from SFTSV(SDTA_2)__KX641914.1__GP
  source 1..3222: mol_type = other RNA
atgatgaaagtcatatggtttagctcactcatatgcctagtcatacaatgcagcggggactcagggccaatcatatgcgcgggacccatccacagcaacaaatcagcggggattcctcacctactagggtattccgagaaaatctgccagatagaccggctaatacacgtctcctcgtggctacgaaatcactcgcaattccaaggatacgtaggtcagagaggaggaaggtcacaggtttcgtactaccccgcggaaaacagctacagccggtggtctggattgttgtctccctgcgacgcagactggctcggaatgctagtcgtgaaaaaggcgaaggaatcggacatgatagttccggggccatcgtacaaaggcaaggtgttcttcgaaagaccgacctttgacgggtacgtaggctgggggtgcggatcaggaaaaagccgaactgaatccggagaactgtgctcgagtgactcagggacctcatcaggacttctaccctccgacagggtactatggataggggacgtcgcatgccaacctatgaccccgatccctgaagaaacattcctcgaactaaaatcattcagccaatcggagttccccgacatatgcaagatagacggaattgtattcaaccagtgcgagggtgagagcctaccacagcccttcgacgtggcctggatggacgtcggccactcccacaaaataataatgagagaacacaaaacaaaatgggtccaagaaagcagctcgaaagacttcgtatgctataaagaaggaacaggcccatgctcagaatcggaggagaaggcgtgcaagacgtcgggatcgtgccgaggggacatgcaattctgcaaggtcgccggatgcgaacacggagaagaagcatcagaagcaaaatgccgatgtagcctggtgcacaagccaggcgaggtcgtggtatcgtacggaggaatgcgcgtaagaccaaaatgctacgggttctcaagaatgatggccaccctagaagtgaacccgcccgagcacatgatcggacaatgcactgggtgccacctagaatgcataaacggcggcgtccgactgatcacgctgacgagcgagctcagaagtgccaccgtgtgcgcgtcccacttctgcagctccgcatcgagcggcaaaaagagcacagaaatccacttccacagcggatcgctagtgggaaaaacggcgatacatgtcaagggcgcactcgtcgacggcaccgagttcacattcgaaggctcatgcatgtttcccgacggctgcgatgcagtggactgcacattctgccgagagttcctcaaaaacccgcaatgttaccccgcaaagaaatggctgttcatcataatcgtaatcctcctaggctacgcaggactgatgctactaaccaacgtactaaaagccatcggggtatggggaagttgggtaatcgccccggtcaaactaatgttcgcgattatcaagaaactaatgagaacagtatcatgcctagtcggcaaactcatggaccgcgggagacaggtgatacacgaagaaataggcgaaaacggagaaggaaatcaagatgacgtccgaatcgagatggctcgcccgcgccgcgttcgacactggatgtacagcccagtcatactgacgatcttggcaatcgggttggccgagggctgcgacgagatggtacacgcagactcgaaactggtatcgtgccggcaagggagcgggaacatgaaagagtgcataacaacagggagagcactgctaccggcagtgaaccccggacaagaagcatgcctccacttcaccgccccaggaagcccagactccaaatgcctgaagatcaaagtaaagagaatcaacctgaaatgcaagaaaagctctagctatttcgtgccagacgcaagatccaggtgtacaagcgtccgcagatgtaggtgggcgggcgactgccaaagtggctgcccaccacatttcacgagcaactcattcagcgacgactgggctggaaaaatggaccgggcaggactcgggttctcgggatgctcagacggctgcggaggggcagcgtgcggctgcttcaatgccgccccatcctgcatcttctggagaaaatgggtcgagaacccacacggaataatatggaaagtatctccctgtgccgcctgggtcccctccgcagtaatcgaactaacaatgccgagcggagaagtacgaaccttccaccccatgtctggcattcccacccaagtcttcaaaggagtctctgtcacgtacctgggaagcgacatggaagtaagtggtctcaccgacctatgcgaaatcgaggaactaaagtcaaagaaactcgcgcttgcaccctgcaaccaggcaggaatgggtgtcgtgggaaaagtaggagaaatacaatgcagctcggaagaatcagcgcgcacaataaagaaagacggctgtatctggaacgcggacctcgtagggatcgaactcagagtagatgacgccgtctgctacagtaaaataacctctgtcgaggccgtggcaaactactccgccatacccacaaccataggcggactccgcttcgaacgatcacacgacagccaagggaaaatatcaggctcgcccctggatataacggcgatacggggatcattctctgtaaattaccgaggactgagactaagcctgtccgaaataacagccacgtgcacaggcgaggttaccaacgtatctggatgctatagctgcatgacaggagcaaaagtctcgattaaactccactcaagcaaaaacagcacagcccacgtgcgatgcaaaggagacgagaccgccttctcagtactagaaggagtacacagttacatcgttagcctctcatttgaccatgccgtagtcgacgaacagtgtcaactaaactgcgggggacacgagtcccaagtcacgctcaaaggcaacctaatattcctagacgtcccaaagttcgtggatggatcatacatgcaaacataccacagcaccgtaccaaccggcgccaatataccaagccctacagactggctaaacgcgttatttggcaatggactatcgaggtggattctaggcgtgattggcgtgctcctaggcggactagcactctttttcctgattatgttcctcctcaaactaggaaccaaacaagtgttcaggagccgaacaaagctagcctga

SEQ ID NO: 16493 - RNA, 3222 nt, synthetic construct
  misc_feature 1..3222: note = derived and/or modified CDS sequence (opt11) from SFTSV(SDTA_3)__KX641915.1__GP
  source 1..3222: mol_type = other RNA
atgatgaaagtcatatggttctccagtcttatctgccttgtcatacaatgtagcggagactcaggacccatcatatgcgcaggcccgatacactccaacaaaagcgccggaatcccacacctcctaggatacagcgagaaaatatgtcagattgataggctgatacacgtaagcagctggctccgaaatcacagccagtttcagggatacgtaggtcaacgcggaggaaggagccaggtctcctactaccccgcagaaaacagttacagcagatggagcggactgctctcgccatgcgacgcagattggctaggcatgctggtcgtaaagaaagccaaagaatccgacatgattgtacccggcccctcgtacaaaggcaaagtattcttcgaacgccccaccttcgacggctacgtcggttggggctgcggctccggaaagtccagaaccgaatcaggcgaactatgcagcagcgacagtggcacgagcagcggactactgccctccgaccgggtcctgtggatcggcgatgtggcgtgtcaacctatgacacccatacccgaagaaaccttcctcgaactcaaatcattcagccaatccgagttcccagacatctgcaaaatcgacggcatcgttttcaaccagtgcgaaggggagtccctcccccagcccttcgacgtagcatggatggacgtagggcattcacacaaaataatcatgcgcgaacacaaaacaaaatgggtacaggagagctcaagcaaagattttgtgtgttacaaagaaggcacgggaccatgcagcgaatcggaagaaaaagcatgcaagacctcaggatcatgccgaggcgatatgcaattctgcaaagtggcaggctgcgagcacggagaggaagcaagcgaagccaaatgccgttgcagcctcgtacacaaacccggcgaagtcgtagtctcctacggcggtatgagagtccgccccaaatgttacggcttctccagaatgatggccaccctagaagtaaacccgcccgagcaacgaataggacagtgcaccgggtgccatttagaatgcataaacggaggagtcagactaataacactcacaagcgaactcagatctgccacagtgtgcgcaagccacttctgcagttcagcgtcgagtggcaagaaaagcaccgaaatacactttcactcgggatccctcgtcggcaagacagcaattcacgtaaagggagccctggtcgacggtaccgagttcacgttcgaaggcagctgtatgttccccgacggatgcgacgcagtcgactgcacattttgccgggagttcctgaaaaacccacagtgctacccagcaaagaaatggctattcatcatcatcgtaattctactaggatacgcagggctgatgctcctaacgaacgtcctaaaagccataggcgtgtggggcagctgggtcatagccccagtcaaacttatgttcgcaataatcaagaaactcatgcgcacagtttcatgcctggtggggaaattaatggaccgaggacgccaagtaatacacgaagaaatcggagaaaacggcgaaggtaaccaggacgacgtacggatcgaagtggccagaccgcgccgagtacgacattggatgtactccccagttatcctaacaatactagccataggactcgctgagggatgcgacgaaatggtccacgcagactcgaaactcgtctcgtgcagacaaggctcaggcaacatgaaagaatgcataacaacagggagagccctactgcccgctgtgaacccaggacaagaagcatgcctccacttcaccgccccgggatctccagactcgaaatgcctcaaaatcaaagtcaaacgcataaatctgaaatgcaaaaagtcatccagctactttgtcccagacgcgagaagcagatgcacgtctgtacgccgatgccgatgggcaggagactgccaaagcggatgtcccccacacttcacctcaaacagtttcagcgatgactgggccgggaagatggaccgggcaggcctgggtttctcgggctgctccgacggctgcggcggggcagcgtgcggctgcttcaacgcagccccatcatgcatcttctggcgaaaatgggtggagaacccacatggaatcatatggaaggtcagcccctgcgccgcctgggttccctcggccgttattgagctgacaatgccctccggagaggtgcgcacattccacccaatgagcggcattccaacacaagtattcaagggagtatccgtcacatacctaggatccgacatggaagtcagcggactaacggatctatgcgaaatcgaagaactaaaaagcaagaaactcgcactcgcgccctgcaaccaggccggaatgggagtagtaggcaaagtcggtgaaatacaatgctcatcggaagaaagcgcacgcaccatcaagaaagacggctgtatctggaacgcggacctggtcgggattgaactaagagtcgacgacgcggtttgttacagcaagatcacatcggtagaagcggtagccaactacagcgcaatccccacaaccatcgggggcttaagattcgaacgctctcacgattcccaggggaagatatccggctcaccacttgacattacagccattcggggatcattctcagtcaactaccgcggactaaggctatctctatcagaaataacggccacgtgcaccggcgaagtcaccaacgtatctggctgctacagctgcatgacaggcgccaaagtcagcataaagctacactcctccaagaactcgaccgcccacgtccgatgcaaaggggatgagacagcattctcagtcctggaaggcgtacactcgtacatcgtgagtctgagcttcgaccacgcggtagtagacgaacagtgccagctaaactgcggaggacacgaaagccaagtcaccctcaaaggcaacctaatcttcctagacgtcccgaaattcgtagacgggtcctacatgcaaacctaccactcaaccgtccccacgggagctaacatcccatcaccaacggactggctaaacgcactgtttgggaacggactcagtaggtggatactcggagtgataggagtgctactaggaggactcgcactgttcttcctcatcatgttcctgctcaaattaggaaccaaacaagtattccgaagcaggacgaaactagcctaa

SEQ ID NO: 16494 - RNA, 3222 nt, synthetic construct
  misc_feature 1..3222: note = derived and/or modified CDS sequence (opt11) from SFTSV(SDTA_4)__KX641916.1__GP
  source 1..3222: mol_type = other RNA
atgatgaaggtcatatggttcagcagcctaatatgcctagtaatacaatgcagtggggactccggtcccataatctgcgcgggtccaatacacagcaacaaatccgcagggatcccgcacctcctaggctactcagaaaagatctgtcaaatagacaggctaatccacgtatcatcatggctgcgcaaccacagtcagttccaaggatacgtaggccaaagaggaggaaggtcccaggtaagctactatccggcggaaaattcctatagcagatggagcggccttcttagcccctgtgacgcggattggctcgggatgttagtagtgaagaaagcaaaagaatcagacatgatcgtgcccgggccctcatacaagggcaaagtattctttgaacgccccacctttgacggctacgtagggtggggctgtggatcgggcaagagccggacagagagcggagaactctgctcgtccgacagcggcacaagcagcggactactgccatcggaccgcgtgctctggatcggcgacgtcgcctgccagcccatgaccccgatccccgaagagacgttcctggagctaaagagctttagccaaagtgagttcccggacatttgcaaaatagacggcatagtatttaaccaatgcgaaggcgagtccctaccccaacccttcgacgtagcatggatggacgtcggacacagtcacaaaatcataatgcgggagcacaagaccaaatgggtgcaggagtccagttcaaaagacttcgtgtgctacaaagagggcacaggaccatgcagcgaatcagaagagaaagcgtgcaaaacaagtggctcgtgcagaggagacatgcaattctgcaaagtagcaggatgcgagcacggggaagaagcatcggaggcaaagtgtagatgttccctcgtacacaaacctggcgaagtagtagtcagttacggaggcatgcgcgtacgaccgaaatgctacggattctcaagaatgatggcgacactggaagtcaacccgcccgaacaaagaatcggacaatgcactggatgccacctagaatgcatcaacgggggagtacgattgataacactaacaagcgaactcagatccgcaaccgtatgcgcaagccatttctgtagttcagccacgtccggaaagaaaagcacggaaattcactttcatagcgggtcactggtaggcaaaacagcaatacatgtgaaaggagcgctcgtggatgggactgagttcactttcgaaggaagctgcatatttccggatgggtgcgacgcagtagactgcacattctgcagggagttcctgaaaaacccgcaatgctatccagctaagaaatggctattcatcatcatcgttatcctcctagggtacgcaggcctgatgctacttaccaacgtactcaaagcaattggtgtatgggggagctgggtaatagccccagtcaagctcatttttgcgatcatgaaaaagctgatgcgcacggtgtcctgcctagtcggcaaactaatggaccgcggaagacaagtgatacatgaagaaatcggagagaatggagaaggaaaccaagacgacgtaaggatcgaaatggcacgtccgcgaagggtcagacactggatgtatagtccagtcatcctaacaatcctagctataggcctagctgagggctgcgacgagatggtacacgccgatagcaagctagtctcatgccgccaaggaagcggaaacatgaaagagtgcataaccacaggcggggccctgctacctgccgtcaacccaggacaagaagcctgcttgcacttcaccgcaccaggatccccggacagtaaatgcctcaaaatcaaggtcaagcgaataaacctcaaatgcaaaaagagctcgagctactttgtgccagacgcacgatcacgatgcaccagtgtgcggagatgcagatgggccggagactgtcaaagcggatgcccgccccactttaccagtaacagcttcagcgacgactgggcaggtaaaatggacagagccgggctgggcttctcgggatgcagtgacggctgcggcggagccgcctgcggatgtttcaacgcggcccccagctgcattttctggcgaaaatgggtagagaacccccatggcatcatctggaaagtctcgccatgcgcagcttgggtaccctcagcagtcatagaactaacaatgccgagcggggaagtacgcacattccaccccatgagcgggattccgacacaagtgttcaaaggagtatctgtcacgtacttgggatcggatatggaagtgagcggactcacggacctatgcgaaatcgaagaactcaagtcgaaaaagctagcactagccccgtgcaaccaggcaggaatgggggtggtcggaaaggtcggggaaatccagtgcagcagcgaggaatccgcgcgcacgataaagaaagatggctgcatctggaacgcggacttggtcggcatcgaactaagggtcgacgacgcggtctgttactcgaaaataacctcggtcgaggcagtagcgaattactccgccatcccaacaacaatcggcggactcaggttcgaacgatcccacgactcccagggcaaaatatcaggctcacccctagacataaccgcgatcaggggatcgtttagcgtaaactatcgagggttgagattaagcctcagcgaaattacggccacatgcaccggcgaagtaactaacgtgagcggctgctacagctgcatgaccggagccaaggtgtcaatcaaactgcactcgagcaagaactcgaccgcccacgtccgatgcaagggtgacgagacagcattttcagtacttgaaggagtacacagctacattgtttcactcagctttgaccacgcggtagtggacgaacagtgccagctcaactgcgggggacacgaatcacaagtaaccctaaaaggcaacctaatctttttagacgtaccgaagttcgttgacggctcgtacatgcagacataccactccactgtgccgacaggcgcaaacatcccatcccctaccgactggctaaacgcactctttgggaacggcctgagcagatggatactgggagtcataggagtactactaggagggctagcactcttctttctgatcatgttcctcctcaagctgggaacaaaacaagtcttcagatctagaaccaagctagcgtga

SEQ ID NO: 16495 - RNA, 3222 nt, synthetic construct
  misc_feature 1..3222: note = derived and/or modified CDS sequence (opt11) from SFTSV(HBGS13_human_2015)__KY440773.1__GP
  source 1..3222: mol_type = other RNA
atgatgaaagtcatatggttctcgtccctcatctgcttcgtaatacaatgctccggagacagtgggccaatcatctgcgcaggcccgatccattcgaacaaatcagcagacatcccgcatctgctggggtactcagaaaagatctgccaaatcgaccgacttatccacgtcagcagctggctgcgaaatcactcccagttccaagggtacgttggacaaagaggaggcaggagccaggtatcatactacccggcagaaaacagctacagccgctggtcaggcctactctcaccatgcgatgccgactggctcgggatgctcgttgtaaagaaagcaaaaggatcagatatgatcgtgccagggccctcgtacaaaggtaaggtgttcttcgagcgaccgactttcgacggatacgtgggctggggctgcggatcaggcaaaagccgaaccgagagcggagagttatgctcgtctgactccggcaccagcagtggcttgttaccctccaaccgggtcctttggataggcgatgtcgcatgccaacctatgaccccaatccctgaagaaacgttcctagagctaaaaagttttagccaaagcgagttcccagacatatgcaaaatcgacggaatcgtcttcaaccagtgcgaaggagaatccctaccccaacccttcgatgtagcctggatggatgtaggtcactcacacaaaatcataatgcgagaacacaaaacgaaatgggttcaggaatcctcaagtaaagacttcgtatgttacaaagaaggcacaggcccgtgcagcgagtccgaagaaaagacgtgcaaaaccagtggcagctgccgcggagacatgcaattctgcaaagtagcgggctgcgaacacggggaagaagcatccgaggccaagtgccgatgcagcctcgtccacaaacccggcgaagttgtagtctcatacggcgggatgcgagtccgtcccaaatgttacgggttcagcaggatgatggcaacgcttgaagtaaatcaaccagagcaaagaatagggcagtgcaccgggtgccacctagagtgtatcaacggcggcgtgagactaataaccctcaccagcgaactaaagagcgcgaccgtttgcgccagccacttctgcagcagcgctacatcaggcaagaaaagcacggaaatacagtttcacagcggcagcctcgtaggcaaaacagcaatccacgtaaaaggcgctcttgtcgacgggacagagttcaccttcgaaggcagctgcatgttcccagacgggtgcgacgccgtggactgcaccttctgcagagagttcctcaagaacccccaatgctaccccgccaagaaatggttattcatcataatagtcatcctactcggatacgccggtctgatgctactaacgaacgtcctcaaggccatcggcatctggggaagctgggtgatagcccctgtcaagctaatcttcgcaatcataaagaaactcatgcgcaccgtaagctgtctaatgggcaaactcatggaccgagggcgacaagtaatacacgaagaaataggggaaaaccgagaaggcaaccaggacgacgtacgaatcgaaatggcacgcccgcgaagagtacgacactggatgtacagcccagtgatactaacaatcctggcaataggcatcgccgagtcatgtgacgaaatggtccacgcagactccaaactggtatcctgccggcaaggcagcggaaacatgaaagaatgcgtgacaacaggtcgcgccctattaccggccgtgaacccagggcaggaggcgtgcctacacttcaccgcacccggcagccccgactcgaaatgccttcgaatcaaagttaaacgaatcaacctcaaatgcaagaaaagcagcagctatttcgtaccagacgcacgatcgagatgcacgtccgtaaggcgatgtaggtgggccggcgactgccaatccggctgtcccccacacttcacaagcaactcgttctccgacgactgggccggcaaaatggacagagcgggcctgggattctcgggatgctcggatggatgcggcggcgccgcttgcggatgctttaacgcagcaccatcttgcatcttctggcggaaatgggttgagaacccacatggcattatatggaaagtgagcccatgcgcagcgtgggtccctagcgccgtaatcgaactaacaatgccctcaggcgaagtaagaacattccacccgatgtcaggaatacccacacaagtgttcaaaggggtctcggtgacctacctaggatcagacatggaagtatctggacttacagacctatgcgagatcgaagaactcaaatccaaaaagctagccctagcgccatgcaaccaagcaggaatgggcgtggtaggcaaagtcggtgaaatacagtgcagctcagaagaatcggcacgcacaatcaagaaagacgggtgcatatggaacgcggatctagttggaatagaactaagagtcgacgacgccgtttgctactcaaaaatcaccagcgtagaagcagttgcgaattacagtgccattcctaccacaataggaggtcttcggttcgaacggagccacgactcccagggaaaaatcagcggctcacccctcgacataacagccatccgagggagcttctcagtgaactacagaggattacgcctgagcctcagcgagataaccgcgacatgcacaggagaggtcacaaacgtaagcggatgctacagctgcatgacaggcgcaaaggtcagcatcaaactgcactcgtccaaaaattcgaccgcgcacgtgcgctgcaaaggggacgaaacagcgttcagtgtcctcgagggagtccacagctacacagtaagcctcagcttcgaccacgcggtggtagacgaacaatgtcaactaaattgcggaggacacgaatcacaagtcacactaaaagggaatcttatcttcctagacgtccccaaattcgttgacggctcctacatgcaaacgtatcactccacagtcccaaccggagccaacatcccaagtcctaccgactggctaaacgccctgttcggaaacgggctctccaggtggatccttggcgtgatgggagtgctgttaggaggattggccctattcatcatcatcatgagcctcttcaaactcggcaccaaacaagtattcagatcgagaaccaaactcgcataa

SEQ ID NO: 16496 - RNA, 3222 nt, synthetic construct
  misc_feature 1..3222: note = derived and/or modified CDS sequence (opt11) from SFTSV(HBMC16_human_2015)__KY440776.1__GP
  source 1..3222: mol_type = other RNA
atgatgaaagtcatctggttcagctctctggtgtgcctagtcatccaatgcagcggagatagcggacccatcatctgcgcgggcccaatccacagtaacaaatcagccgggatcccgcatctgctcggctattctgagaaaatatgccaaatcgacaggctcatacatgtatcttcttggctacgaaaccactcacaattccaagggtacgtaggccagaggggaggacggagccaagtctcatactacccagcagaaaacagctacagccggtggtcggggctactctcaccatgcgacgccgactggctaggaatgttagtagtgaaaaaggccaagggatcggacatgatcgtccccggaccaagttacaaaggaaaagtcttctttgaacgaccaaccttcgacggttacgtgggatggggctgcggctccggcaaaagccggaccgagtccggggaattatgctcaagtgactccgggacatcgtcaggactcctaccctctgaccgagttctctggatcggagacgtggcatgccagcccatgacacccatcccagaagaaaccttcctcgagctcaagagcttcagtcagtccgagttccctgacatctgcaagatagacgggatagtattcaaccagtgcgaaggcgaaagtctgccccaaccctttgacgtcgcttggatggacgtcggacactcgcacaaaataataatgagagaacataaaaccaaatgggtgcaggaatcgtcctcaaaagacttcgtctgctacaaagagggcaccggaccatgcagcgaatcggaagaaaaagcatgcaagactagcggttcatgccgaggcgacatgcaattctgcaaagtagccggctgcgaacacggagaggaggcttcagaggcaaagtgccgatgcagcctagttcacaaaccaggcgaagtagttgtctcgtacggaggtatgcgtgtacgcccaaaatgctacggattctcccgcatgatggcaaccatggaagtaaatccgcccgaacaaagaatcggacaatgcacaggctgccaccttgaatgcataaacggcggtgtacgactcatcacactcaccagcgagctcaagagcgcaacagtgtgtgcaagccacttctgcagcagcgccacgagcggtaagaaaagtacagaaatacacttccacagtggatcactcgtgggcaaagcagccatccacgtcaagggcgcgctagtcgacgggaccgagttcacattcgaaggctcatgtatgttccccgacgggtgcaacgcagttgactgcacattctgccgtgagttcctaaagaacccccaatgctaccccgcaaagaaatggctctttattatcatcgtcatcctgctaggttatgcaggtctgatgctcctaacgaacgtactcaaagcgataggcgtctgggggagctgggtcatagcacccgtcaaacttatgttcgccattatgaagaaactaatgcgcactgtatcttgcttagtcgggaaattgatggacagaggacgccaagtaatacacgaagagataggagaaaacggcgaagggaaccaagacgacgtgaggatagagatggcacgaccccggagagtcaggcactggatgtacagcccggtcatcctaacaatactggcgataggactggcggaaggctgcgacgagatggtccacgccgacagtaaactggtatcatgccggcaaggttctgggaacatgaaagaatgcgtaaccacaggacgggccctgctccctgccgtgaacccgggccaagaagcatgcctacacttcacagcaccagggagcccagacagcaaatgtctaaaaatcaaagtcaagcgcattaacctgaagtgcaaaaagagctcatcctatttcgtgccagacgcaaggagcagatgcacaagcgtacgacgatgcagatgggcaggcgactgccaaagcggctgcccgccccacttcacctcgaacagttttagtgacgactgggcagggaagatggatcgcgccggcctaggcttctctggctgcagcgatggctgcggcggcgcagcatgcgggtgcttcaacgccgccccatcctgcattttctggcgcaaatgggtcgagaacccgcacggaataatatggaaggtttcgccatgtgccgcgtgggtaccctcagcagttatcgagctcacaatgccgagcggagaagtgcgcaccttccaccccatgtccggaatccctacacaggtctttaagggagtatcagtaacctatttgggcagcgatatggaagtcagcggtctcactgacctgtgcgagatcgaggaactgaaaagtaagaaactcgcactcgccccttgcaaccaagcagggatgggagttgtaggaaaagtcggtgaaatacaatgttcttccgaagaaagcgctcggaccataaagaaagatggctgcatctggaacgcggacctggtcgggatcgaactccgagtcgacgacgccgtttgctacagcaaaataacatccgtcgaagcggtggccaactacagcgccatacccacgaccataggaggcctacgattcgaacgatcacacgacagccaagggaaaatatcaggctcacccttagacataacagccatacgaggctcattctcagtaaactacagaggtctacgcttgagcctctcagaaataacggcaacgtgcacaggcgaggtaaccaacgtcagcggctgctacagctgcatgacaggtgcaaaagtcagcataaaactccactcgagtaaaaactccaccgcccacgttcgatgcaaaggcgacgagaccgcattctcggtactcgagggggtacactcatatactgtgagcctatcattcgaccacgcggtcgtcgacgaacaatgccaactcaattgcggaggacacgaatcgcaagtgacactaaaaggcaacctaatatttctcgacgtccccaaattcgttgacggctcatacatgcaaacataccacagcactgtgcccacgggagccaacatcccctcccccaccgactggctgaacgcactcttcggcaatggcctaagtagatggatactaggagtgatcggcgtactactcggcgggctagcgctgttcttcctaatcatgttcctattcaagctcgggaccaaacaggtcttccgaagtaggaccaaactagcctga

SEQ ID NO: 16497 - RNA, 3222 nt, synthetic construct
  misc_feature 1..3222: note = derived and/or modified CDS sequence (opt11) from SFTSV(HBMC5_human_2016)__KY440770.1__GP
  source 1..3222: mol_type = other RNA
atgatgaaagtcatctggttcagctcgctggtatgtctcgtgattcaatgtagcggcgactcgggcccgatcatatgcgccggccctatccactcaaacaaatcggccggaatccctcatctgctagggtacagtgaaaagatatgccagatagacaggctcatccacgtgagttcgtggctacgtaaccactcacaattccagggatacgtgggacagcgcggaggcaggagccaagtcagctactatccggcagaaaacagctacagcagatggagcggcctgctttcaccctgcgacgcggactggctaggaatgctggtggtaaagaaggcaaagggcagcgacatgatcgtccccggaccctcctacaaaggcaaggtcctattcgagcgccctaccttcgacggatatgtcggatggggctgcggatcaggcaagagccgcacggaaagcggagagctctgcagcagcgacagcgggacatctagtggactgctgcctagcgaccgagtcctatggatcggagacgtagcgtgccaacctatgacacccatcccggaggaaactttcctagagctcaagagcttcagccaaagcgagttcccggacatatgtaagatcgacggaatagtctttaatcaatgcgaaggggaatccctaccgcaacccttcgacgttgcatggatggacgtcggacactcacacaaaatcatcatgagggaacacaagacaaaatgggtgcaagaatcgagctcgaaggacttcgtctgctacaaagaaggaacgggcccctgcagcgaaagcgaagagaaagcctgcaaaacatccggatcttgcagaggcgatatgcaattctgcaaggtcgccggctgcgaacacggagaagaagcaagcgaagcaaaatgccgctgcagcctcgtacacaagcctggagaggtagtcgtaagctacggtggaatgagagtgagaccaaaatgctacggattctcccggatgatggcaaccatggaagtaaatccaccggaacaaaggataggccagtgcaccggatgccacctcgaatgcatcaacggaggcgtccgcctgataaccctcacgagcgagctgaaaagcgccacggtatgcgctagtcacttttgcagctcggcaaccagcggaaagaaatccaccgaaatccacttccactcaggctcgctagtcggcaaagccgccatccacgtaaagggcgccctagtggacggaacagagttcacgtttgaaggatcatgcatgttcccggacggctgcaacgcagtagactgcacattctgcagagaatttctaaagaacccacaatgctacccagcgaagaaatggctattcatcataatcgtaatactcctaggatacgcgggactgatgctcctcacaaacgtcctcaaagctatcggagtgtggggaagctgggtaatcgccccggtcaaactaatgttcgccatcatgaagaaactcatgaggaccgtctcttgcctagtaggtaaactcatggaccgcgggcgtcaagtcatacacgaagaaataggagaaaacggagaaggaaaccaagatgacgtcagaatcgaaatggcgcgaccgcggcgagtccgtcactggatgtatagcccggtcatactaacaatactagccataggactcgcagaaggctgcgatgaaatggtccacgccgacagcaagctagtatcctgccggcaaggaagcggaaacatgaaagagtgcgtgaccacaggcagggcattactccccgcagtcaatcccgggcaggaagcatgtctacactttactgcacccggaagcccagacagcaaatgcctcaaaatcaaagtcaaacgcattaacctgaagtgcaaaaagagctcgagctatttcgttccagacgcgcgaagtaggtgcacgagcgtacgacgatgtcgttgggcgggagactgccaaagcggatgcccgccgcacttcaccagcaattccttcagcgacgactgggccggcaaaatggaccgtgctgggttaggattctcaggatgcagcgacggctgtgggggagccgcctgtggatgcttcaacgcagcaccaagctgcatattttggcgaaagtgggtagaaaacccccacggaataatatggaaggtcagcccatgcgccgcgtgggtacccagcgcagtaatcgagctaacaatgcccagcggggaggtacggaccttccacccaatgagcggaatacccacccaagtattcaaaggcgtaagcgtaacttacctgggctcggatatggaggtatccggactaacagacctctgtgaaatagaagaactaaaatcaaagaaattagccctggctccttgcaaccaagccggaatgggggtagtgggcaaagttggagaaatccaatgctcaagcgaagaaagcgcgcgcacaatcaagaaagacgggtgcatctggaatgcggaccttgtcggaatcgaattgcgagttgacgacgccgtttgctactcaaaaatcaccagcgtcgaagccgtcgctaactattcggcaataccgacaaccatcggcggacttcgattcgagcgttcacacgactcacaaggaaaaatttccggatcaccactcgacataacagccatccggggatcattcagcgtaaattatcgcggcctccgtttgtcgttaagcgagataacagcgacatgcacgggcgaagtcaccaacgtaagcgggtgttacagttgcatgaccggagccaaagtcagcataaaacttcactcatccaaaaactcgactgcacacgtccgatgcaaaggcgacgagacagccttctcagtcctagaaggagtacactcctacactgtctccctcagcttcgaccacgccgtggtagacgaacagtgtcagctgaactgcggcggacacgaatcacaagtaaccttaaaaggaaacctcatcttcctagatgtccccaaattcgtcgacggaagctacatgcaaacataccactccacagtgccgacaggagcaaacataccttcccctacggactggctaaacgccctcttcgggaatggactaagccgatggattctcggcgtaatcggcgtccttctagggggtctagcgctgtttttcctgataatgttcttattcaaactaggaacaaaacaagtgttccgcagccgcaccaaactggcctaa

SEQ ID NO: 16498 - RNA, 3222 nt, synthetic construct
  misc_feature 1..3222: note = derived and/or modified CDS sequence (opt11) from SFTSV(HB29)__KP202164.1__GP
  source 1..3222: mol_type = other RNA
atgatgaaagtaatatggttttcgtcactaatatgcctggtcatacagtgcagcggagactcaggtccgataatatgcgcaggaccaatccacagcaacaaatcagccggaataccgcacctcctcggctactccgagaaaatctgccagatagaccgcctaatccacgtctcctcatggctccggaaccactcacaatttcaaggctacgtaggccagcgcggaggcagaagccaagtcagctactacccagcggaaaatagctactcccggtggtccggactgctctcaccatgcgacgcggactggttagggatgctagtcgtgaagaaagcaaaagaatcagatatgatcgtgcccgggccgtcctacaagggaaaagtcttctttgagcgacccacttttgatgggtacgtaggctggggctgcgggtccgggaagagtcgaacggagagcggagagctatgcagcagcgactcgggaacctcgagcggcctactaccctcagaccgggtactatggatcggagacgttgcctgccaaccaatgacgcctatacccgaagagacgtttctcgagctaaagagcttcagccaaagcgagttcccagacatctgcaaaatcgacggaatagtcttcaaccaatgcgaaggcgaaagtctaccccaaccatttgatgtagcctggatggacgtagggcactcacacaaaatcataatgagagaacataagacaaaatgggtccaagaatcgagctccaaagacttcgtatgctacaaggagggaacaggaccctgcagcgaatccgaagaaaaagcgtgcaaaacctccggcagctgcagaggcgacatgcagttctgcaaagtcgctggctgcgaacacggggaggaagctagcgaagcaaaatgtcgatgcagcctagtacacaagccgggggaagtcgtggtctcatacggaggcatgcgcgtacgaccaaaatgctacggattctccaggatgatggcgaccttagaagtaaacccgcccgaacaacgtatagggcaatgcacaggatgtcacctagaatgcataaacggaggagtgcgcctaatcacactcacctccgaactacgatccgcaaccgtgtgcgcgagccacttctgctcctccgcatcaagtggaaagaaatccaccgagatacacttccactcaggctcactcgtgggaaaaaccgcaattcacgtaaaaggcgccctggtggacggcacggagttcacattcgaaggaagctgtatgttcccagacggttgtgatgcagtagattgcaccttttgcagagagttcctcaaaaacccgcaatgctacccagccaagaaatggttattcattataatcgtgatccacctaggctacgcgggactaatgctgctaaccaacgtactcaaggccatcggcgtatggggcagctgggtcatcgccccggttaaactcatgttcgcaataataaagaaactaatgagaacagtaagctgcctggtcgggaaattaatggacaggggccgccaagtcatacacgaagaaataggagaaaacggggaagggaatcaggatgacgtacgaatcgaaatggcacgccccagacgggtcaggcactggatgtattcaccagtcatcctgacaatcctagcaattggactagccgaaggatgcgacgaaatggtccacgccgacagcaaacttgtgagctgcagacaaggatctggcaatatgaaagaatgcatcaccacaggccgtgcactgcttcccgccgtcaacccgggccaagaagcatgcctacatttcacagcgccagggagcccagactccaaatgtctaaaaataaaagtgaaacgcataaacctcaaatgcaagaaaagcagctcctacttcgtgcccgacgcaagaagccgatgcacaagcgtacgcagatgcagatgggccggcgactgccaatccggttgcccgccccacttcaccagcaactccttcagcgacgactgggccgggaaaatggacagggcagggttggggttctcaggttgctccgacggttgtggaggagcagcctgcgggtgtttcaacgcagcaccaagttgcattttctggcgaaaatgggtagaaaacccacacggcataatatggaaagtcagtccatgcgcagcctgggtaccctccgcagtaatagaactcacaatgccgagcggggaagtgcgaacattccatcccatgtccggaataccaactcaggtcttcaaaggagtctcagttacgtacctaggcagcgatatggaagtaagcggactgacggacctctgcgagatcgaggaactaaagtcgaagaaacttgcgctcgcaccctgcaaccaggcaggcatgggagtcgtgggcaaagtcggagaaatacagtgttcatccgaggaatccgcacggacaataaagaaagacggatgtatatggaacgccgacctagtcgggatagaacttcgcgtggacgacgcagtctgctattccaaaataactagcgttgaagctgtcgctaactacagcgccatcccaacaaccatcggcggactacgctttgaacggtcacacgacagccaaggcaaaatctctggaagcccactagacataacagccatacggggatcctttagcgtgaactaccggggcctccgactcagcctctccgaaataaccgccacatgcactggagaagtaacgaacgtaagtggctgttacagctgtatgacaggcgccaaagtatcgataaaactacacagttctaaaaacaataccgcccacgtccgatgcaaaggcgacgagacagcgttctccgtactggaaggggtccacagctacatcgtgagcctctcgtttgaccacgcagtagtagacgaacagtgccagcttaactgcggtgggcacgaatcccaagtaacgctaaaaggcaacctcatcttcctagacgtaccaaaattcgtagacggctcgtacatgcagacctaccactcgaccgtcccaacaggagccaacatcccctcgccaacagactggcttaacgccctcttcggcaacggcctgagccgatggatcctcggagtcatcggagtactgttgggtggactcgctctattcttcctgatcatgttcctgctgaaactcggaacaaaacaagtcttcagaagccggactaaactagcctaa

SEQ ID NO: 16499 - RNA, 3222 nt, synthetic construct
  misc_feature 1..3222: note = derived and/or modified CDS sequence (opt11) from SFTSV(HNXY_115)__KC292312.1__GP
  source 1..3222: mol_type = other RNA
atgatgaaagtcatctggttctctagcctaatctacttcgtaatccaatgctccggcgactcgggttcaataatctgtgccggcccaatacatagcaacaaatccgcagacatcccccacctcctcggatactccgagaagatctgccaaatagacaggctcatccacgtcagctcctggttgcgcaaccactcccaattccaaggatacgtgggacaacgcggcgggcgcagtcaagtaagttactatcccgcagagaactcatacagccgatggtccggcctgctcagcccctgcgacgccgactggctcggcatgctggtcgtcaagaaggcaaagggctcagacatgatcgtacccggaccaagttacaagggaaaggtgtttttcgaacgaccaaccttcgacggatacgtaggctggggctgcggatccggtaaatcacgaaccgagagtggcgagctgtgcagcagcgatagcggaacctcaagtggcctactgccgtccgacagggtcctatggataggcgacgtggcatgccaaccaatgacccccattccagaagaaacattcctagagctcaagagcttctcacaatcagagttcccagacatatgcaagatagatggaatagtcttcaatcagtgcgagggcgaaagccttccccaacccttcgacgtcgcgtggatggacgtcgggcactcccacaagattataatgagagaacacaaaaccaagtgggtacaggaaagcagcagcaaggacttcgtatgctacaaagaaggcacaggcccctgctcagaaagcgaagagaaaacatgcaaaacctcgggctcctgccgaggcgacatgcagttctgcaaagtagcaggctgcgagcacggcgaagaagcaagcgaagcgaaatgcagatgtagcctcgtccacaaacccggcgaagtcgttgtgtcgtacggcggaatgagggtgcgccccaaatgctacggattcagccgaatgatggccaccctcgaggttaaccagcctgagcaaagaatcggtcaatgcaccgggtgccacctcgaatgcatcaacggcggcgtgcgcttgatcacactcacctcggagctcaaatccgccaccgtatgcgccagccacttttgcagcagcgccactagcggaaagaaaagcacagaaatccaattccacagcggaagcctcgtgggcaaaacggcaatacacgtcaaaggcgcactcgtcgatggaacagaatttacattcgaaggctcttgcatgttccccgacggttgtgacgccgttgactgcacattctgccgggagttcctgaaaaacccccagtgctaccccgccaagaaatggctatttataatcatcgtgattcttctcggctacgccggactaatgctactaacaaacgtgctcaaggcaataggaatatggggctcatgggtcatcgcaccagtaaagctaattttcgcaatcataaagaaactcatgcgaacagtgtcctgcctaatgggcaaactgatggaccgaggtcgccaagtcatacacgaagaaattggcgaaaaccgagaaggtaaccaagacgacgtacgaatagagatggcccgaccaaggcgagtacgccactggatgtacagccccgtaatactcacaatcctagccataggcctagccgaaagctgcgacgagatggttcacgcggacagcaagctagtctcctgcagacaaggcagtggaaatatgaaagaatgcgtaacaacaggacgtgcactactcccagctgtcaatccaggccaagaagcgtgcctacacttcaccgcccccggctccccagactcaaaatgcctcaaaatcaaagttaaacgcatcaacctcaaatgcaagaaaagcagcagctacttcgtacccgacgcgcgttccagatgcacaagcgtacgaagatgccggtgggccggtgactgtcaaagcggctgcccaccacacttcacctcaaactcattctcagacgactgggcaggcaaaatggaccgggcagggctcggattctcaggctgttccgacgggtgcggcggcgccgcatgtggctgtttcaacgcggccccaagctgcatcttctggaggaaatgggtagagaacccacatggaatcatatggaaagtcagtccctgcgccgcctgggtaccgagcgcagtaatagaactcaccatgccatcaggagaagtccgtaccttccatccaatgtccggcatcccaacccaagtcttcaaaggggtgtcagtcacctacctcggatcagacatggaggtcagcgggctgacagacctatgcgaaatcgaggaactcaaaagcaagaaactcgcgctcgctccatgcaaccaagccggcatgggggtagtgggcaaagtcggagagatacaatgctcctctgaagagagcgcgcgcacaatcaagaaagacggatgcatttggaacgcagacctagtcggcatcgaactgcgcgtagacgatgcagtatgctactctaaaataaccagcgtagaagcagtcgcaaactactccgcaatccccacaaccataggcggcctacgcttcgagcgttcccacgattctcaaggcaaaataagcggctcgccactagacatcaccgcaatacggggcagcttcagtgtcaattacaggggcctaagactcagcctatccgagatcaccgcaacctgcacaggagaagtcacaaacgtctccggatgctattcatgcatgacaggcgcaaaagtctccatcaaactgcactcctccaaaaactcaacagcccacgtacgctgcaaaggagacgaaacagcattctcagtcctcgaaggcgtccactcatacaccgtctccctgagcttcgaccacgcagtcgttgatgaacaatgccagctaaactgcggaggacacgagtcacaagtaacactcaaagggaatctcatattcctagatgtgccaaaattcgtagacggctcatacatgcaaacctatcacagcacagttccaacaggcgccaatattccgtcacccacagactggctaaatgccctgttcggcaacggcctatccagatggatcctaggagtgataggagtgctcctaggcggactagcactcttcttcatgataatgagtctgtttaaactcgggaccaaacaagtattccgatcacgaacaaaactcgcgtaa

SEQ ID NO: 16500 - RNA, 3222 nt, synthetic construct
  misc_feature 1..3222: note = derived and/or modified CDS sequence (opt11) from SFTSV(HNXY_144)__KC292307.1__GP
  source 1..3222: mol_type = other RNA
atgatgaaagtgatatggttcagctcactaatctgcttcgtcatccaatgctccggagactcgggaccaatcatatgcgcaggcccaatccattccaataaatcagccgacatcccccacctcctaggatactcagagaaaatctgccagatcgacaggctaatacacgtctcctcctggctaaggaaccatagccaattccaagggtatgtgggtcaacgaggcggacgcagccaagtcagttactacccagccgaaaattcatactcacgttggagcgggcttctttcaccctgcgacgccgactggctcggcatgctggtggtaaagaaagccaaaggatcagacatgatagtcccaggaccctcctataagggcaaagtcttcttcgaacgacccacctttgacggctacgtgggatggggctgcggttctggcaaatccagaaccgaaagcggagaactctgcagctccgactccggcacctcaagcggactacttccaagtgatagagttctctggatcggcgatgtagcctgccaaccgatgacaccgatccccgaagaaacattcttagagctaaagagcttcagccaaagtgagttccccgacatttgcaaaattgacgggatcgtattcaaccaatgcgaaggagaaagcctcccccagccattcgacgtcgcctggatggacgtcggccattcacacaaaattataatgcgagaacacaaaaccaaatgggtccaagaaagctcatcaaaagatttcgtctgctacaaagaagggactggcccatgcagcgaatccgaagagaaaacctgcaaaacatcagggtcttgccgcggcgacatgcaattctgcaaagtcgccggatgcgaacacggagaagaagcatcagaggccaaatgccgttgcagcctagtacataaaccgggcgaagtcgtcgtatcatacggaggtatgcgcgtccgaccaaaatgctatggtttcagtcgtatgatggcgaccctagaagtaaaccaaccagaacagagaatcggccaatgcaccggctgccacctcgaatgcatcaacgggggtgttcgcttaataacattaacgtcggaactgaaatccgcaaccgtctgcgcgtcacacttctgcagctccgccacatccgggaagaaaagcaccgaaatacaattccactccggcagccttgtcgggaaaaccgccatacatgtgaaaggagcactcgtcgacggcacagagttcaccttcgaaggtagctgcatgttcccggacggttgcgatgccgtagactgcaccttctgcagagagttcctaaagaacccgcaatgctacccagcgaaaaagtggctattcatcatcatagtaatactgctcggctacgcgggtctaatgctcctcacaaacgtcctcaaagctatcggaatctggggatcatgggtgatagcacccgtcaagctcatatttgccattattaagaaactcatgcgcacagttagctgtctaatgggcaaactaatggatcgtgggcgtcaagtaattcacgaagaaattggcgaaaaccgtgaaggaaaccaggatgacgtccgaatagaaatggcacgccccaggcgagtacgacactggatgtatagcccagtgatcctcacgatcctagccatcggattagcggaaagctgtgacgaaatggtccacgcagactccaaactggtcagctgccgccaaggcagcggcaacatgaaagaatgcgtcacaaccggccgagcactcctgccagccgtaaacccaggccaagaagcgtgtctacatttcaccgcccccggatcaccggacagtaaatgcctcaaaatcaaagtcaagaggatcaacctcaaatgcaagaaatcgtcaagttacttcgtcccggacgcaaggagccgctgtaccagcgtcaggcgctgccgatgggcaggcgactgtcaaagcgggtgtcccccacacttcacatccaacagcttttccgacgactgggctgggaaaatggaccgggccggactgggcttcagcggatgctcagacggctgcggaggcgccgcgtgcgggtgcttcaacgcagcacccagctgcatcttctggaggaaatgggtcgaaaacccacacggcatcatctggaaagtcagcccctgcgccgcatgggtaccgtcagccgtcatcgagctaacaatgccaagcggcgaagtacgcacctttcaccctatgagcgggatacccacacaagtcttcaaaggagtctcagtcacctacctgggttccgacatggaggtcagcggtctaacagacctatgcgaaatcgaggaactaaaatcaaagaaactagccctcgcaccatgcaaccaagccgggatgggcgtggtaggcaaagtcggagaaatccaatgttcctcagaagagtccgcgcgcacaatcaagaaagacggctgtatctggaacgccgacctcgtcggaatcgaactacgcgtggacgacgctgtctgctactccaaaatcacctccgtagaagccgttgccaactactcagccataccaaccaccataggaggactcagattcgagaggtcccacgatagccaaggcaaaatctccggatcacccctagacatcacagccatccgcgggtccttcagcgtgaactacaggggcttacgcctaagcctctccgaaatcaccgcaacatgcacgggagaagtcaccaacgtaagcggatgctatagctgcatgacaggagccaaggtcagcatcaagctccacagctccaagaactccaccgcccacgtacgctgcaaaggcgacgaaactgcattcagcgtcctagaaggagtacattcgtatacggtcagcttatcattcgaccacgccgtcgtagacgagcagtgccaactaaactgcggcggacacgaatcccaagtcaccctgaaagggaacctcatctttctcgacgtacccaaattcgtcgacggcagctacatgcaaacctaccacagcaccgtccccacaggcgccaacatacccagccccaccgactggctgaacgcactcttcggaaatggcctctcaagatggatcctcggcgtcatgggagtactcttgggcggtctagcactctttttcatgataatgtcgttattcaaactagggaccaagcaagtatttcgaagtcggactaagctcgcgtaa

SEQ ID NO: 16501 - RNA, 3222 nt, synthetic construct
  misc_feature 1..3222: note = derived and/or modified CDS sequence (opt11) from SFTSV(HNXY_157)__KC292305.1__GP
  source 1..3222: mol_type = other RNA
atgatgaaagtaatatggttcagctcactgatctgcttcgttatacaatgcagcggggactcggggcccattatatgcgcaggcccgatacacagcaacaaatctgcagacatcccccacctactgggatactcggagaaaatctgccaaatagaccgcttaatacacgtcagttcgtggctgcggaaccatagccaattccaaggctatgtagggcaaagaggagggcgcagccaagtctcatactacccggcagaaaactcctattcccgatggtccggcctactctcaccgtgcgacgccgactggctcggaatgctagtagtcaagaaagcaaaaggctcagacatgatagttcccggaccctcatacaaagggaaagtcttcttcgagcgacccacattcgacgggtacgtaggatggggctgtggatcaggtaaaagcagaacagaaagcggagagctatgctccagtgatagcggtacgagcagcgggctcctgccctcgaacagagtactgtggataggcgatgtcgcgtgccagccgatgacccccatcccagaggagaccttcctcgagctaaagagcttctcccagagtgagttcccggacatatgtaaaatcgacggcatagtattcaaccaatgcgaaggagaatcactcccacagccattcgacgtagcgtggatggatgtcggccactcacacaaaataataatgagggaacataaaacgaaatgggtacaggaaagcagcagcaaagactttgtctgctacaaagaggggaccggaccctgcagcgaatccgaagagaaaacatgcaaaacgagcggaagctgccgaggagacatgcaattctgcaaagtagccggatgcgagcacggagaagaagccagtgaagcgaaatgtagatgcagcttagtgcacaaacccggtgaggtagtggtcagctacggagggatgcgcgtacgacctaagtgttacgggttctcacggatgatggcaacactagaggtaaaccaacccgaacaacgtataggccaatgcacagggtgccacctcgaatgcatcaacgggggcgtacgcctgataacactaactagcgaactcaaaagcgcaacagtgtgcgcgtcacacttctgcagctccgcaacgtcgggtaagaaaagtacggagatacagttccacagcggcagccttgtgggaaaaacagctatacacgtaaaaggagccctagtagacgggaccgagttcacattcgaaggcagctgcatgttccccgacggatgcgacgccgtagactgtacgttctgcagggagttcctcaagaacccacaatgttatccggctaagaagtggctgttcataatcatcgtaattctactaggctacgccgggctcatgttactcacgaacgtactcaaagcgataggcatatggggaagttgggtcatagccccggtcaaactcatattcgccataatcaagaaattgatgcgcacagtaagctgcctaatgggcaaactgatggaccgcggcaggcaagtcatacacgaagaaataggggaaaaccgggaaggaaaccaggacgacgtcagaatagaaatggcgcgtccacggagagtaaggcactggatgtattccccagtcatacttacaattctggcgatagggctggccgaaagctgcgatgaaatggtccacgccgacagcaaactcgtatcatgccgccaaggaagtggcaacatgaaggaatgcgtcacgacagggagagcactgctgccggcagtgaacccaggacaagaagcctgcctacacttcacagccccggggagtccagactccaagtgtctcagaatcaaggttaagcgaatcaacctgaagtgcaagaaaagtagcagctacttcgtcccagacgcacgaagccggtgcacatcggtccggcgatgccgctgggccggagactgccaaagcggctgcccgccccatttcaccagcaacagcttctcagacgactgggcaggaaaaatggacagagcaggcctcggattcagcggatgctcagacggttgcggaggcgcagcgtgcgggtgcttcaacgcggccccgagctgcatcttctggagaaaatgggtagaaaacccacacggcatcatttggaaggtctcaccctgcgcagcatgggtaccctccgccgtaatagaactaaccatgccatcaggggaagtccgcacattccacccaatgagcggcatacccacacaggtatttaaaggagtatcagtcacgtaccttggaagtgacatggaggtctcaggcctgaccgacctgtgtgagatagaagaactgaaaagcaagaaattagcacttgcaccctgcaaccaggcgggaatgggcgtcgtaggaaaagtaggcgaaatacaatgctccagcgaagaaagtgcacgcacaataaagaaagacggttgcatctggaatgccgacctggtgggcatcgaactccgagtcgacgacgcggtctgctacagcaaaatcacaagcgtcgaggccgtcgcgaactacagcgccatccccacaactataggagggcttagattcgagcgaagtcacgacagccagggcaaaataagcggaagtcccctcgacataacggccattagagggagcttcagcgtaaactatcgcggcctacgcctgagcctaagcgaaatcaccgccacatgcacgggagaggtaacgaacgtcagcggctgctatagctgcatgacaggagcaaaggtctcaataaaactacatagcagcaaaaattcgacagcgcacgtgcgctgcaaaggtgatgaaacagcattctcagtactcgagggtgtccactcctacacagtcagcctcagctttgaccatgccgtcgttgacgaacaatgccagctaaattgcggcggccacgaatcgcaggtcaccctcaaaggaaatctaatattcttagatgtaccgaagttcgtagacggaagctacatgcaaacataccactcaacagtcccgacaggagcgaacatcccgagtcccaccgactggctcaatgcgctattcggcaacgggctatccagatgggtactaggggtcatgggagtattactcggcggacttgcgctgttcttcatgataatgagcctcttcaaactaggcacgaaacaagtattcagatccagaaccaaactagcgtga

SEQ ID NO: 16502 - RNA, 3222 nt, synthetic construct
  misc_feature 1..3222: note = derived and/or modified CDS sequence (opt11) from SFTSV(HNXY_170)__KC292304.1__GP
  source 1..3222: mol_type = other RNA
atgatgaaagttatctggttttccagcctaatctgcttcgtcatccaatgcagtggagactcaggccccatcatatgcgcgggacccatccactccaacaagtccgcagacatcccacatctactaggctacagcgagaaaatctgccaaatagatcgcctaatacatgtttcatcctggctacgaaaccactcccaattccaaggatacgtcggccaaagaggtgggcgaagccaagtatcctattacccagcagaaaactcatacagccgatggagtgggctactcagcccctgcgatgcagactggctagggatgcttgtcgtaaagaaagcaaaaggcagcgacatgatcgtgcccggccccagctacaaagggaaagtgttcttcgagagaccaaccttcgacgggtacgtcggctggggatgcggctccggcaaaagtagaaccgaaagcggagaattatgcagcagcgacagcggcacatctagtggcctcctcccctccaaccgagtgctctggattggagacgttgcatgccaaccgatgacgccaatacccgaagagaccttcctcgaactcaaaagtttcagtcaaagtgagttcccagacatctgcaaaatagacggtatagtattcaaccaatgcgaaggcgagtcgttgccccaaccattcgacgttgcatggatggacgtaggacatagccacaaaataataatgcgcgaacacaaaacgaagtgggtccaagaatcctcatccaaagactttgtatgctacaaagaaggaacgggtccctgctccgaatccgaagagaagacatgcaaaacctccggatcatgtcggggagacatgcaattctgcaaagtagccggctgcgagcacggcgaagaagccagcgaagccaagtgccgctgctcactggtccacaaacccggtgaagtagtcgtatcatacggcggaatgcgcgtacgcccgaaatgttacggcttctcccgcatgatggcgacccttgaagtcaatcaaccagagcaacgcataggacaatgcaccggatgtcacctcgaatgcataaacggaggagtacgattgatcacgctaacatcggaactcaaaagcgcgacggtctgcgcctcacacttttgctcaagcgccacctcaggaaagaaatctacagaaatccagttccacagcggaagcctcgtcggcaaaacagccatccacgtaaaaggcgcgctggtagacggaaccgaatttacgttcgaagggtcatgcatgttcccagacggatgcgacgcagtcgactgtaccttctgccgagagttcctcaaaaaccctcaatgctaccccgctaagaaatggctatttatcatcatcgtaatcctactaggctacgcaggtctcatgttactaaccaatgtcctgaaagcaattggaatatggggatcctgggtgatcgccccagtcaaattaatcttcgctataataaagaaactcatgcgcaccgtctcatgcctcatgggcaaactcatggaccgaggacgacaagtcatccacgaagaaatcggagagaaccgggaaggcaaccaggacgacgtcagaatcgagatggcccgcccaaggcgagtccgacactggatgtactccccggttatcctcacaatactcgccatcggactggccgaatcatgcgacgaaatggtccacgcagactccaaactcgtatcctgccgccaaggaagcggcaacatgaaagaatgcgtcacaacgggccgcgcgctcctccccgcggtcaatccaggacaagaggcctgcctccacttcaccgcccccggctcgccagactccaaatgcctaagaatcaaagtcaaacgcataaacctaaagtgcaaaaagtcgtcatcttacttcgtcccagacgcaaggtcacgatgtacgagcgtacgacgatgcagatgggccggcgactgccaaagcggatgcccaccacacttcacctcaaacagcttcagcgacgactgggcaggcaaaatggaccgagcagggctaggattctcaggctgctcagacggatgtggcggcgccgcatgtggctgcttcaacgcagccccatcatgcatattctggaggaaatgggtcgagaacccgcacggcatcatctggaaagtctcaccatgcgccgcctgggtgccatccgcagtaatcgagctcaccatgccaagcggagaagtacgcacgttccaccccatgagcgggatacccacacaggtatttaaaggagtcagcgttacgtacctaggttccgacatggaagtaagcggcctaacagatctctgcgagatcgaggaactcaagagcaagaaactcgcactagctccttgcaaccaagccggcatgggagtagtaggaaaagtcggagaaatccaatgctcctcagaagaaagcgcacgaacaatcaagaaggacggctgcatctggaatgccgacctagtaggcatcgaactaagagtcgacgacgccgtgtgctactcgaagattacctccgttgaagccgtcgcaaactacagcgccattccaaccaccataggcgggctacgattcgaacgctcacatgactcccaaggaaaaataagcgggagcccgctcgacatcaccgccataagaggcagcttctctgtcaactacaggggattacggctatcactcagcgaaatcaccgcgacatgcactggagaggtaaccaacgtatccgggtgctactcatgcatgacaggcgcaaaagtctccataaaactccattcatccaaaaacagcacggcacatgtaaggtgcaagggggacgagaccgcattcagtgtcctagaaggagtccactcctacacagtaagcctctccttcgaccacgccgttgtcgacgaacagtgccagctcaactgcggcggccacgaaagccagataaccctcaagggcaacctaatcttcctcgacgtccccaaattcgtcgatggaagctacatgcagacctaccattccactgtaccaaccggagccaacatcccgagtcctaccgactggctcaacgccctcttcggcaatggacttagtcgatgggtcttgggcgtcatcggcgttctgctcggcggcctagcactcttcttcatgattatgagcctattcaaactaggcactaaacaggtattccgtagccgaaccaaacttgcgtag

SEQ ID NO: 16503 - RNA, 3222 nt, synthetic construct
  misc_feature 1..3222: note = derived and/or modified CDS sequence (opt11) from SFTSV(HNXY_174)__KC292306.1__GP
  source 1..3222: mol_type = other RNA
atgatgaaagtcatctggttctcatcgctaatatgcttcgtcatacaatgctccggagacagcggccctatcatatgcgccggccccatccacagcaacaaatcggccgacataccgcacctactaggctactctgagaagatatgtcaaatagaccgcctcatccacgtgagctcctggctccgaaaccacagtcaattccaagggtacgtgggacagcgcggaggccgaagccaagtcagctactaccccgccgaaaatagctacagccgctggtccggcctgctatccccatgcgacgcggactggctaggcatgctagtagtcaagaaagctaaaggctcagatatgatagtacccgggcccagctataaaggcaaagtatttttcgaacgtcccacattcgatggatatgtgggctgggggtgcggctcgggaaagagccgcacagaaagcggggaactctgctccagcgacagcgggacctccagcggactactcccaagcgaccgggtattatggatcggcgacgtcgcctgtcagcccatgacccccatcccagaagagaccttcctggaactaaaatccttcagccaatcggagttccctgacatctgccgcatcgacggtattgtcttcaaccaatgcgaaggagaatcactcccccagccctttgacgtggcctggatggacgtcggacattcccacaaaataataatgagggaacacaaaacaaaatgggtccaggaaagctcctccaaagacttcgtctgctacaaagaggggacgggaccctgctcagagagcgaagagaaaacatgcaagaccagcggatcatgccgcggggacatgcaattttgcaaggtcgccgggtgcgaacacggagaagaggcctcggaggcaaaatgccgctgttcgctagtacacaagccaggagaagtcgtagtcagctacggcgggatgagggtgcgcccgaaatgctatggattctcacgcatgatggcaactctagaggtaaaccaaccagaacaacgaatcggacaatgcacaggatgccacctagaatgcatcaacggaggcgtgagattaataacgctcaccagcgaactaaaaagcgcaacagtgtgcgcgagccatttctgctcaagcgcgacgagcgggaagaaaagcaccgagatacaattccacagcggatcccttgtcggcaaaacagcgatacacgtgaaaggcgccctggtagacggcaccgaatttaccttcgaaggatcgtgcatgttccctgacggatgtgacgccgtcgactgcaccttctgccgggaatttctcaaaaacccacaatgctaccccgccaaaaagtggctattcatcatcatagtaatcctcttaggatacgcaggcttaatgctgcttacgaatgtacttaaggccatcggcatatgggggtcatgggtaatagccccagtgaagctgatcttcgccatcataaagaagctcatgcgaaccgtgagttgcctcatgggcaagctaatggaccgtgggagacaagttatacacgaagaaatcggagaaaacagggaaggaaaccaggacgacgtccggattgaaatggcaaggcctaggagagtgagacactggatgtacagcccagtgatcctaacaatcctggccataggcctagcagagagctgcgacgaaatggtccacgcagacagcaaactcgtcagctgcaggcaaggtagcggaaacatgaaagaatgcgtaaccacgggcagagctctactaccggcggtcaacccgggccaagaggcatgccttcatttcacagcccccggaagccccgacagcaaatgcctaaggataaaagtcaaaagaatcaacctgaaatgtaagaaaagctccagctacttcgtgcccgatgccagaagcagatgcacatccgtcaggcgctgcagatgggcaggcgactgccaaagcggatgcccgccacacttcacaagcaacagcttctcagacgattgggccgggaaaatggacagagccggcctcggcttctcaggctgcagcgacggctgcggaggggccgcctgcggatgcttcaacgcagccccgtcctgcatattctggaggaaatgggtcgaaaacccgcacgggataatctggaaagtcagcccatgcgccgcctgggttccctcagcagtcatcgaactcacaatgccaagcggagaggtacgcaccttccacccaatgtcaggcatcccaacccaggtcttcaaaggggtctccgtcacatacctaggaagcgacatggaggtaagtggcctaactgacctatgcgaaatagaagaattaaaaagcaagaaactagcactagcgccctgtaaccaagccggaatgggcgtagtcggcaaagtcggcgagattcaatgttcatcagaggaaagcgcacgcacaatcaagaaagatggctgcatatggaatgcagacttagtcgggatcgaactacgtgtcgacgacgcagtctgctattccaaaatcacaagcgtggaagccgtagcaaactacagcgccatccccacaacgataggaggactccgattcgagcgaagccacgactcccaaggtaagatttccggcagccccctggacataaccgcgatcaggggcagcttcagtgtgaactacaggggtcttcgactcagcctctccgaaataacggcaacctgcaccggtgaggtcacgaacgtatcaggatgctactcctgcatgaccggagcaaaagtcagcatcaaactccactcgagcaaaaactcaacagctcacgtacgatgtaaaggagacgagacagccttctcagtcctcgaaggagtacatagctatacagtctcactatcgttcgaccacgccgtagtggacgaacaatgccaactaaactgcggtggccacgaaagccaagtaactttaaaaggaaacctaatcttcctcgacgtaccaaaattcgtcgacggatcgtacatgcaaacataccatagcaccgtaccgacgggagccaatataccttccccgaccgactggctgaacgcccttttcggcaacggaatgagccggtggatattaggagtcatgggcgtgctcctcggcgggctcgcactcttcttcatgataatgagcctatttaaactaggaaccaaacaagtgttccgcagccgcacaaaactcgcctag

SEQ ID NO: 16504 - RNA, 3222 nt, synthetic construct
  misc_feature 1..3222: note = derived and/or modified CDS sequence (opt11) from SFTSV(HNXY_182)__KC292324.1__GP
  source 1..3222: mol_type = other RNA
atgatgaaagtcatatggttcagctcactgatctgcttcgtgatacagtgctccggagactcaggaccaatcatctgcgcagggccgattcacagcaacaaaagcgccgacataccacacctacaaggctactcggagaagatatgccaaatagacagactaatccacgtcagctcgtggctacgcaaccacagccaattccaaggctacgtcggtcaacgaggagggcgcagccaggtatcgtactatcctgccgagaatagctactcgaggtggagcggcctcctatctccctgcgacgccgattggctaggcatgctcgtcgtaaagaaagcaaaagggagcgacatgatcgtacccgggccctcatacaaaggcaaagtattcttcgaacgaccgacgttcgacggatacgtaggctggggctgcggctcgggcaaaagcagaaccgaaagtggagaattatgcagcagtgacagcggcaccagcagcggactgctaccatccgaccgggtactgtggataggggacgtcgcatgccaaccaatgacaccaataccagaagaaaccttcctcgaactcaagagcttctcacagagcgagttccccgacatctgcaaaatcgacggcatagtattcaaccagtgtgaaggcgaaagcctcccacagccgttcgacgtggcctggatggacgtcggtcactcacacaaaatcataatgagagaacacaagaccaaatgggtgcaagaaagctccagtaaagacttcgtatgctataaagaaggcaccgggccatgctcggaatcagaagagaaaacatgcaagacatccggctcctgtcgcggggatatgcaattttgcaaagtagcaggttgcgaacacggggaagaggcttccgaagcaaaatgccggtgcagcctagtgcacaaacccggcgaagtagtagtgtcttacggaggcatgcgggtcagaccaaaatgctacggattcagcagaatgatggccaccctagaagtcaaccagccagaacaaagaattgggcaatgcaccggttgccatctcgaatgcatcaatgggggcgtaagactcatcacactgacatccgaactaaagagcgcgaccgtctgcgccagccacttctgctcctcagcaacaagcggcaaaaagtccaccgaaatacaattccattccggctcgctagtaggcaaaacagccatacacgtgaagggagctctagtcgacggcacagagttcacattcgaagggagctgcatgttccccgacggatgtgacgcagtagactgcacattctgcagggagttcctcaaaaacccacaatgctacccagccaaaaagtggctgttcataataatagtcatcctccttggatacgccggactaatgttactcacaaacgtcctaaaggcaatcggcatatggggatcatgggttatcgcaccggtcaagctgatcttcgcaatcatcaagaaactcatgagaacagtcagctgcttgatgggtaaactgatggaccgaggccgacaggtaatccacgaagaaatcggagaaaaccgggaaggtaaccaggacgatgtaaggatcgaaatggcccgacccagaagagtgaggcactggatgtactcaccagtaatcctaacgatcctcgccataggcctcgcagaatcatgcgacgaaatggttcacgccgactcaaagctagtatcctgccgacaagggtccggaaacatgaaagaatgcgtgaccacaggccgcgcattactcccagcagtaaacccgggacaggaagcctgcctgcacttcactgcaccaggcagccccgacagcaaatgcctcaaaataaaagtcaaaagaattaacctaaaatgcaagaagagttcgagctacttcgtgcccgatgcccgaagtcgatgcacgtcagtgagacgatgccgatgggcaggcgactgccaatccggatgtccccctcacttcaccagcaacagcttcagcgacgactgggcaggaaaaatggacagagccggcctcgggttctccggctgctcagacggctgcggcggggcagcgtgcggatgcttcaacgcggctccaagctgcatcttctggagaaaatgggtcgaaaatccacacggtataatctggaaagtctcaccatgcgcagcatgggtaccctcagccgtgatcgaactgacaatgccatcaggggaagtgcgaactttccatccaatgagcgggatcccaacccaagtattcaaaggagtctccgtaacctacctgggatcagacatggaagtaagcggactgacagacctatgcgagatcgaggagctcaaatcaaagaaactggcactcgcaccctgcaaccaagcaggaatgggggtagttggcaaagtcggagaaattcaatgcagttcggaagaatcagccagaacaataaagaaagacgggtgcatatggaatgcggatctagtcgggatcgaactgagggtagacgacgctgtctgttactccaaaataaccagtgtagaggccgtcgccaactactcggcaatcccaacaacaatcggcggcctacgattcgagcgcagtcacgactcccaaggaaaaatctccgggagcccactcgacatcaccgcaatcaggggctcgttcagtgtcaactaccggggactcaggctaagcctgagcgagataacggccacgtgcacgggtgaagtcacgaacgtcagcggctgctactcctgcatgacaggcgccaaagtaagcatcaaactacactcaagcaaaaactcaaccgcacacgtgcgctgcaaaggggacgagaccgcgttcagtgtcctggaaggcgtacactcctacacagtgtccctgtcatttgaccacgccgtggtcgacgaacagtgccagttaaactgcggcggccacgagtcccaagttaccctcaagggaaacctaatattcctcgacgtacctaaattcgtcgacggctcatacatgcaaacctaccacagcaccgttccgacgggtgcaaatataccatcacctacagactggctgaacgcactcttcggcaacggactgagccggtggatcctcgggcttatcggagtcctactcgggggactagccctgttcttcatgattatgagcctcttcaagctcggcactaaacaggtctttaggtcgaggacaaaactagcctga

SEQ ID NO: 16505 - RNA, 3222 nt, synthetic construct
  misc_feature 1..3222: note = derived and/or modified CDS sequence (opt11) from SFTSV(HNXY_188)__KC292301.1__GP
  source 1..3222: mol_type = other RNA
atgatgaaagtaatatggttcagcagcctaatctgcctcgtcatacaatgcgggggcggaacaggaccgatcatctgcgccggcccaatacactcaaacaagtcagccgacatcccgcacctcctcgggtacagcgagaaaatatgccaaatagacagactaatacatgtatcgagctggctgcgcaaccacagccaattccaaggctacgtaggacaaagaggcggcaggtcccaagtatcgtactatcccgcagaaaatagttatagcagatggtccggactgttaagcccgtgcgacgccgactggctaggtatgctagtcgtgaagaaagccaagggctcggacatgattgtgccagggccaagctacaaaggaaaggtattctttgaacggccgaccttcgacggatacgtaggctggggatgcggatcgggaaagagccgaacagaaagtggagaactgtgctcaagtgacagtgggacatcgtcaggactcttaccatcggacagggtactctggataggcgacgtggcatgccagcccatgaccccaataccggaggaaacattcctcgagctcaagagcttcagccaaagcgagttcccagacatatgcaaaatcgatggaatagtcttcaaccaatgcgaaggagagagcctacctcaacccttcgacgtggcctggatggacgtcgggcacagccacaaaataattatgagagagcacaagacaaagtgggtacaagagagctccagcaaagacttcgtgtgctacaaagaaggcaccggcccatgcagcgaatcggaggagaagacatgcaaaacgtcaggatcgtgtagaggagacatgcagttctgcaaagtagcaggatgcgagcacggcgaagaagcatccgaagcaaaatgtagatgcagcctcgtacataaacccggcgaagtagtggtctcgtatggagggatgagggtgcgcccaaaatgctacgggttctcgcgcatgatggccacgctagaggtgagccaaccagaacaacgcatcgggcagtgcacgggatgccacctggaatgcataaatggcggggtccgcctgattacgctaacaagcgagctaaagagcgcaacagtatgtgcaagccacttttgcagctccgcgacgagtgggaagaaaagcacagagatacaatttcacagcggctcactcgtaggaaaaacagccatccacgtcaaaggagctctagtcgacggaacagagttcacgttcgaaggctcatgcatgttccccgatggatgcgacgcagtcgactgcacattctgcagagagttcctaaagaatccacagtgctacccagcaaagaaatggctattcataataatagtaatcctcctaggatacgcgggactaatgctgctcaccaacgtcctaaaagcaataggggtctggggcagctgggttatcgcgcccgtaaaactcgtatttgccataataaagaaactaatgcgcgcggtaagctgcctaatggggaaactcatggacagaggacgacaagtgatccacgaagaaataggcgaaaacagagaaggaaatcaggacgacgtccggatagaaatggcacgaccgcgaagagtacgacactggatgtacagcccggttatactcactatcctggctatcggcctggcagaggggtgcgacgaaatggtgcacgccgacagcaaactcgtgtcatgcagacagggaagcggcaacatgaaagaatgcgtgacaacaggccgagccctcctcccggcagtgaacccaggccaagaagcatgcttacacttcacagcgcccgggagccccgacagtaaatgcctcaagattaaggtcaagcgcatcaacctgaaatgcaaaaagagctcctcctacttcgtccccgacgcaaggtcccgctgcacaagcgtaagacggtgtagatgggcgggagattgccaaagcggatgtcctccccacttcacaagtaattccttcagcgacgactgggccgggaaaatggacagagcaggactaggatttagcggctgctcagacggctgcggcggagctgcgtgtggctgcttcaacgcagcaccgtcctgcatattctggaggaaatgggtcgagaacccacacggcataatatggaaggtaagtccctgcgcagcatgggtcccctcggcagtcatcgagctgaccatgccaagcggcgaagtccgaacgttccaccccatgtccggcatcccaacacaggtcttcaaaggcgtcagcgtcacctaccttggatccgacatggaagtgagcggcctgaccgacctctgcgaaatcgaggaactcaagagcaagaaacttgcgctcgcgccctgtaatcaagccgggatgggggtcgtaggcaaagtcggcgaaattcaatgcagctcagaggaatcggcacgcactataaagaaagacggctgtatttggaacgcggacttagttggcatagaactccgtgtggacgacgcggtatgctactcaaaaataacctcagtggaggccgtagctaactactccgctatacctacaacaatcggcggcctacgatttgagagatcccacgacagccaaggcaaaataagcggaagtccactcgacattacagctataagaggctcgttcagcgtaaactacagggggttacgtttgtcattatccgaaatcacagcaacatgcacgggagaagttacaaacgtgagcgggtgctatagctgcatgacaggggcgaaagtcagcatcaaattacactcttccaaaaactcaaccgcgcacgtgcgctgtaaaggagacgagactgcgttctcagtgctggaaggggtacactcatacagcgtgtccctgagcttcgaccacgcagtagtggatgagcaatgccagctaaactgcggaggccatgagtcgcaagtcacactgcgcgggaacctgatattcctagacgtcccaaaattcgtcgacggcagctacatgcaaacctaccacagcaccgtccccacaggagcgaacatccccagcccaaccgactggctgaatgccctattcggtaacggcctgagtagatggatactaggggtcataggggtactcctaggaggactagcgctattcttcctcatcatgagcttgttcaaactcggtacaaaacagatcttccgaagccgaacaaagctcgcataa

SEQ ID NO: 16506 - RNA, 3222 nt, synthetic construct
  misc_feature 1..3222: note = derived and/or modified CDS sequence (opt11) from SFTSV(HNXY_191)__KC292323.1__GP
  source 1..3222: mol_type = other RNA
atgatgaaagttatctggttcagcagccttatatgcctcgtcatacaatgcggaggagacacgggtccgatcatctgcgcaggccccacccacagcaacaaatccgccgacataccgcatctgctaggatattcagagaaaatctgccaaatagaccgactcatacacgtatcatcatggctacgcaaccactcccagttccagggatacgtcgggcagcgaggaggcaggagccaagtgtcatactaccccgcagaaaacagttattcacgctggtcaggtctactctcaccctgcgacgcggattggcttgggatgcttgtcgtcaaaaaggcaaaagggagcgatatgatagtacccggaccatcctacaaggggaaagtatttttcgaacgcccgacattcgacggatacgtcgggtggggttgtgggtcaggaaaaagcaggaccgaaagcggagaactgtgctccagcgacagcgggacgagcagcggactactcccttcagaccgcgtactgtggataggcgacgttgcgtgccaacctatgacacctattccggaagagacttttctcgagctcaagagctttagtcaaagcgagttcccagacatctgcaagatagacggcatagtcttcaaccaatgcgaaggcgaaagcctaccccaaccgtttgacgtggcctggatggatgtcggacactcacacaagatcataatgagagaacacaaaacaaaatgggtccaagaatcaagctcgaaagacttcgtatgctataaagaagggaccggcccgtgctctgaatcagaagagaaaacatgcaagacctcaggctcctgtagaggagacatgcaattctgcaaagtagccggatgtgaacacggagaagaagcctcagaagcgaaatgcagatgctcccttgtccacaaacccggcgaggtcgtagtttcgtacggaggaatgcgagtaagacccaaatgttacggattctcgcgtatgatggccaccctcgaagtgagccagcccgaacagcgcataggtcaatgcacaggttgccaccttgagtgcatcaacggcggggtcagactgattacactcaccagcgaattgaaaagcgccacagtctgcgcaagccacttctgcagcagcgccacgagtgggaagaaaagcactgaaatacaattccactcagggagcctcgtaggaaaaacagcgatacacgtcaaaggagccctagtagacggaaccgagttcacattcgaagggtcgtgcatgttccccgacgggtgcgacgcagtggactgcaccttctgcagggaatttctcaaaaacccacagtgttaccccgcaaagaaatggctattcatcatcatcgtcatactcctaggatacgcaggcctaatgctcctgacgaacgtattaaaagccataggcgtgtggggctcctgggtcatcgcccccgtcaaactcgtgtttgccatcataaagaaattaatgcgagccgttagctgcctgatgggtaaactaatggaccgaggaaggcaggtcatccacgaagaaatcggcgaaaaccgcgaaggcaaccaagacgacgtccgaatagaaatggcgcggccgcgacgagtcagacactggatgtacagcccagtaatactgacaatcttagccataggactcgccgaaggatgcgacgagatggtccatgcagacagtaagctagtcagctgccgacaaggcagcggaaacatgaaagaatgcgtcacaaccggacgcgcgctcctaccagcagtcaaccccggccaggaagcatgcctacacttcacagcgcccggaagcccggacagtaagtgtctcaaaatcaaggttaaacgcatcaatctcaaatgcaaaaagagttcaagctacttcgtacccgacgcacgctcacgatgtacctcagtacggcgatgccggtgggccggagactgccagagtggttgcccgccacacttcacctccaatagcttcagcgacgactgggccgggaaaatggatagagccggactagggttctccggctgctccgacggctgcggcggagcggcatgcgggtgcttcaacgccgcaccgagttgcatattctggcggaagtgggtcgagaacccgcatggtataatatggaaagtcagcccctgcgcagcgtgggtgccctcagccgtcatagaactcacaatgccctcaggtgaagtgcgcacattccacccaatgagcggcatccccacccaggtcttcaaaggcgtatccgtaacatacctcggcagcgacatggaagtaagcggactcacagacctctgcgaaatcgaggaactcaaatccaagaaactcgctctcgcgccatgtaaccaggcaggcatgggagtcgtgggaaaagtcggagaaatacagtgctcctcagaagaatccgcacgaacaatcaagaaagacgggtgcatctggaacgctgacctcgtaggcatagagttaagagtagacgacgcagtatgttatagcaaaatcacaagcgtcgaggccgttgcgaactacagtgccatacccaccaccatagggggtctaaggttcgaacgatcacacgacagccaaggaaaaatctcaggttcgcccctggacataaccgcaataaggggctcattctcagtaaactacagaggattgcgcctcagcctgagcgagatcacagctacctgtacgggtgaggtaacaaatgttagtggctgttacagctgcatgacgggagccaaagtaagcataaaactacactcaagcaagaactcgacggcgcacgtcaggtgcaagggagacgagaccgctttcagtgtcctggaaggggtccacagctacagcgtgagccttagcttcgaccacgccgtcgtggacgaacagtgtcaactaaactgcgggggacacgagtcccaagtgactctgcgcgggaacttgatattcctcgacgtcccgaagtttgtcgacggatcctatatgcaaacatatcacagcacagtcccaacaggagcaaatataccgagcccgaccgactggctaaacgcacttttcgggaacggcctatccagatggatactaggcgtcataggggtactgctcggaggactcgcgcttttctttctaatcatgagcctattcaaactagggacaaagcaaatcttcagaagccgtaccaagctcgcgtga

SEQ ID NO: 16507 - RNA, 3222 nt, synthetic construct
  misc_feature 1..3222: note = derived and/or modified CDS sequence (opt11) from SFTSV(HNXY_195)__KC292326.1__GP
  source 1..3222: mol_type = other RNA
atgatgaaggtgatctggttcagctcgctcatatgcttcgtcatccaatgctccggcgacagtggacccatcatatgtgcaggccccatacatagcaataagtcggcggacattccacacctacagggatactccgagaaaatctgtcaaatagacaggctcattcacgtcagcagctggctcagaaaccactcacaattccaaggttatgtaggccaacgcgggggaagaagccaagtctcctactaccccgcagaaaacagttactcccgctggtcaggcctcctgagcccctgcgacgcagactggctagggatgctcgtagttaagaaggccaaagggtccgacatgatagtgccaggcccgagctacaaaggcaaagtattcttcgaaagaccaacgttcgacggatacgtcggatggggatgcggatccgggaaaagcagaaccgaaagcggagaactttgctcgagcgacagtggcacttcgagtggactactcccttcggacagagtcttatggattggagacgtcgcctgccaacccatgacacccatccccgaggaaaccttcctcgaactaaaatcattctcccagagtgagttccccgacatctgcaaaattgacgggatagtctttaatcaatgcgaaggagaatcactcccccaacccttcgacgtcgcctggatggacgtgggccactcccacaaaataatcatgagggagcacaaaacaaaatgggtgcaagaatcgagcagcaaagacttcgtgtgctacaaagagggcacaggaccatgcagcgaatccgaagagaaaacgtgcaaaacgtccggctcgtgcaggggagacatgcaattctgcaaagtagcaggctgcgaacacggagaagaagccagcgaagcaaaatgcagatgcagcctggtacataaaccgggggaagtcgtagtatcctatggagggatgcgcgtgcggccaaaatgctacgggttctcgagaatgatggcgacgctagaagtgaaccaacccgaacagagaataggacaatgcaccggctgccacctcgaatgcatcaacggaggcgtacgcttaatcaccctgacaagcgaactcaaatcggcaaccgtgtgcgccagccatttctgcagctccgccacgagcgggaagaaaagtacagaaatacaattccacagcggttcacttgtaggcaaaacggccatccacgttaaaggcgcccttgtcgacgggacggagttcacattcgaaggctcgtgcatgttcccagacggatgcgatgcagtagattgcaccttctgtcgcgagttcctaaagaacccccagtgctacccggccaagaaatggttattcatcatcatagtcatcctccttggctacgcaggactaatgttacttaccaatgtactcaaggcgatcggcatctggggatcatgggtaatcgccccagtcaagctcatattcgccatcataaagaaactcatgagaacggtctcatgcctcatgggaaagctgatggaccgaggccgccaggtcatccacgaagaaatcggagaaaacagagaaggaaaccaggacgacgtccgaattgaaatggcccgaccgcgcagggtaaggcattggatgtactcacccgtcatcctaaccatactagcaatcggcctagccgaaagctgcgatgaaatggtacatgcagacagcaagctagtcagctgccgccaagggagcggcaacatgaaggagtgcgtgaccacagggagagcactcttaccggcagtcaacccgggacaagaagcctgcctgcacttcacggccccaggtagcccagactcaaaatgcctaaaaatcaaggtcaagaggatcaacctcaaatgtaaaaagtccagcagctacttcgtcccagacgcacgctccagatgtacgtctgtacgcagatgcagatgggcaggagactgccaaagcgggtgcccgccccacttcactagcaacagcttcagcgacgactgggccggcaaaatggaccgagcaggactcggattttccggctgcagtgacggctgcggcggagccgcatgcggctgcttcaacgcggcgcccagctgcatcttctggcgaaaatgggtcgaaaatccccacggaatcatatggaaagttagcccgtgcgcggcatgggtacccagcgccgttatcgagctgacaatgccatccggggaggtacgaaccttccacccgatgagcggcatacccacacaggtgttcaaaggcgtcagcgtcacataccttgggtccgacatggaagtctccggcctaaccgacttatgcgagatcgaagaactaaaatcgaagaaactcgcactagccccctgcaaccaagctggaatgggcgtagtggggaaagtaggagaaatccaatgctctagcgaagaaagcgcccgaaccatcaagaaagacggctgcatatggaacgccgacctcgtggggatcgaattaagagtcgacgatgcagtatgctatagcaaaatcaccagtgtagaggccgtagcgaactactcagcgatacccaccaccataggcgggctcaggttcgaacgctctcacgactcccagggcaaaatatcaggctccccgttagacatcacagccatccggggcagcttctcagtgaactacagaggactccgactatcgctgagcgaaatcacggcaacctgcacaggcgaagtaaccaacgtatcgggatgctacagctgcatgacaggcgcgaaagtaagcataaaattacatagtagcaagaactcgaccgcacatgtaagatgcaaaggcgacgagacagcgttctcagtcttagagggagtacacagctacactgtgtcattatcattcgaccacgcagtagtcgacgaacaatgccagttaaactgcggcggccacgagagccaagtaaccctaaaagggaatctgatattcctagacgtaccaaagttcgtcgacggctcgtacatgcaaacgtaccacagcactgtcccaaccggcgccaacataccgagccccaccgactggctaaacgcccttttcggaaacggcctcagccgatggatcctcggtgtgataggagtcctgttaggcgggctagccctattcttcatgatcatgagcctattcaagctcggaacaaagcaagtcttcagaagccgcaccaagctagcctaa

SEQ ID NO: 16508 - RNA, 3222 nt, synthetic construct
  misc_feature 1..3222: note = derived and/or modified CDS sequence (opt11) from SFTSV(HNXY_2)__KC292318.1__GP
  source 1..3222: mol_type = other RNA
atgatgaaagtaatatggttcagcagcctaatatgctttgtaattcaatgcagcggagacagcggcccaatcatctgcgcaggaccaatccactcaaacaaatcagccgacatcccacacctactaggatacagcgaaaagatctgccagatcgaccgactaatacacgtctcgtcctggctcagaaatcactcgcaattccaaggatacgtagggcaaagagggggtcggagccaggtatcctactacccagcagagaacagctacagcagatggtcagggctactctcgccgtgtgacgctgactggctaggaatgttagtagtgaaaaaggcaaagggctcagacatgatcgtcccagggccatcctacaaaggcaaagtatttttcgaaagacctacattcgatggctacgtcggctggggctgcggcagcggcaagagccgaacggaatcaggggaactctgcagcagcgactccgggacaagcagcggcctactcccctcagacagggtactatggataggagacgtcgcctgccaaccaatgacgcccatccctgaagagacgtttctagagctaaagagcttcagtcagtccgagttccccgacatatgcaaaattgatggaatagtttttaatcaatgcgaaggagaatcacttccccaaccattcgacgtcgcctggatggatgtcggccacagccacaaaataatcatgagagagcacaagacgaaatgggtccaggagtcgagctccaaagacttcgtttgctacaaagaaggcacagggccgtgctcggaaagcgaggagaaaacatgcaaaacctccggaagctgcagaggcgatatgcaattttgcaaagtggccggttgcgaacacggagaagaagccagcgaagctaaatgcagatgcagcctcgtccacaagccgggagaggtcgtggtctcatacggcggcatgcgtgtgagaccaaagtgttacggattctcgcgcatgatggcgacactagaagtcaaccaaccagagcagaggatcggacaatgcacaggatgccacctcgagtgcataaacggcggcgtacgcctcatcaccctaacaagcgagctaaaatccgcaaccgtgtgcgccagccacttctgctccagcgccaccagcggaaagaaaagcacagaaattcaattccacagcggcagtctcgtaggcaaaacagcaatacacgtcaaaggagcactcgtagacggaacagaatttaccttcgaaggaagctgcatgttcccagacggatgcgacgccgttgactgcaccttctgtagagagttcctcaaaaacccacaatgctacccagccaagaaatggctattcatcatcatagtgatcctccttgggtacgctggcctgatgttactcacaaacgtcctgaaagcaatagggatatggggatcgtgggtcatcgcccctgtcaagctaatattcgcaataattaaaaagctcatgaggacagtgagttgcctaatgggtaaactgatggaccgcggacgtcaagtcatacacgaagagatcggcgaaaacagggaaggaaatcaagacgacgtccgcatcgagatggcaagaccaagacgcgtaagacactggatgtatagtccggtaatcctcacgatcctcgcaatcggcctcgcggaatcctgcgacgaaatggtccacgcggactccaaactggtatcgtgccgccaaggaagcggaaacatgaaagagtgcgtaacaacgggcagagctctgctgccagccgttaacccggggcaagaggcctgcctacacttcactgcaccaggcagcccggactccaaatgcctcaagatcaaagtcaaaagaataaacctgaaatgcaagaaatcctcaagctatttcgtacctgacgctcggagccgttgcaccagcgtccgaagatgccggtgggccggagactgccagagcggctgtccaccccatttcacgtccaacagcttcagcgacgactgggccggaaaaatggacagagcaggcctcgggttctcaggctgctccgacggttgtggtggcgccgcatgcggatgctttaacgccgcccccagctgcatattctggcggaaatgggtagaaaacccacacggaataatatggaaagtctccccctgtgccgcctgggtgccaagcgcagtaatagaactcacaatgccgtcaggagaggtccgcacgttccacccaatgtcgggaatcccaacacaagttttcaaaggcgtgagcgtcacgtacctgggctcggatatggaggtcagcgggctgaccgacttatgcgaaattgaggagttaaaatcgaagaaactggcactggcaccgtgcaaccaagccggcatgggagtggtaggaaaagtaggggaaatccagtgctcctcggaagaatcagcacgaaccataaagaaagatggatgcatttggaacgccgacctggttggtatagagcttagagtagacgacgcagtatgctacagcaaaataaccagtgtagaagcggtcgcgaactactcggccataccaacaaccataggcggccttcggtttgagcgatcgcacgactcccagggcaaaatatcaggctcgcccctggacataacagcaataagaggctcattctcagtcaattacagaggcctaagactgagcctgtcagaaatcacagcaacctgcaccggggaggtcaccaatgtatccggatgctactcctgcatgacaggggccaaagtaagcatcaaactgcactcgagtaaaaactcgaccgcccatgtacgctgcaaaggggatgagaccgcattcagcgtcctggaaggcgttcacagctacacagtctccctgagcttcgaccacgctgtcgtcgacgaacaatgccaactcaactgcggcggccatgaatcacaagtcacactaaaaggaaatctcatattcctagacgtgccgaaattcgtagacggatcatacatgcaaacctaccactccacagtgccaaccggcgccaacataccaagtcccactgattggctcaacgcactcttcggcaacggcatgtcgaggtggatattgggagtaataggtgtactactaggcggactagcactcttcttcatgatcatgagcttgtttaaattggggaccaaacaagtattcagaagccggacgaaactggcctga

SEQ ID NO: 16509 - RNA, 3222 nt, synthetic construct
  misc_feature 1..3222: note = derived and/or modified CDS sequence (opt11) from SFTSV(HNXY_202)__KC292325.1__GP
  source 1..3222: mol_type = other RNA
atgatgaaagtcatatggtttagctccctaatatgcttcgtcatccaatgcagcggagatagcggaccaataatatgcgcgggacccatacattccaacaaatcggcagacatacctcatctgctcggctactcagagaaaatatgccaaatagaccgcctaatccacgtaagctcctggttacgaaaccactcgcaatttcaaggatacgtaggccaaagagggggacgtagccaggtcagctactaccccgcggaaaacagctatagccggtggagcggcctcctctccccatgcgacgccgactggctcgggatgttagtcgtaaagaaggccaagggctcagacatgatcgtgcccggtccatcttacaaaggcaaagtattctttgaacgccctaccttcgacgggtacgtcggctggggatgcggctcaggcaaatctaggacagagagtggtgaactgtgctccagcgactcgggtacctcgtctgggctcctcccaagcaacagagtcctttggataggagacgtagcatgccaaccgatgacgccaatacccgaggaaacattcctagagctcaagagcttcagccaaagcgaatttcccgacatatgcaaaatagatggaatcgtattcaaccagtgcgaaggcgaaagcctcccccaaccattcgacgtggcatggatggacgtcgggcacagccacaaaataatcatgagagaacacaaaaccaaatgggtccaagaaagctcctcaaaagatttcgtttgctacaaagaaggcaccggcccctgcagcgaatcagaagagaaaacctgtaaaacttccggctcgtgccgcggtgacatgcagttctgcaaagtcgcagggtgcgaacacggagaagaagcgtcggaagcaaaatgtcgatgcagcctagtgcacaaacccggtgaggtcgtcgtctcatatggcggaatgcgagtacgcccgaaatgctatggattctcacgcatgatggctaccctagaggtaaaccagcccgagcaacggattggccaatgtactgggtgccacctcgaatgcatcaacggaggcgtacgactgataacactcacatccgaactcaagagcgcaaccgtctgcgcctcgcacttttgcagttcggccacgtccggcaaaaagagcacagagatacaattccactccggctccctggtaggaaaaaccgccatacacgtaaaaggcgccctcgtcgacggaacagagttcacgttcgaaggcagctgcatgttcccagacggatgcgatgccgtcgactgtacattctgcagagagttcctcaagaacccacaatgttacccagcaaagaaatggctattcattataatcgttatcctgctcggctacgccggcctaatgctactaaccaacgtccttaaagcaatcggcatctggggaagctgggtaatcgctcccgtcaaattaatattcgcgatcataaagaaattaatgcgaacggtatcatgcctaatgggcaaactcatggaccgcggccgacaagtaatacacgaagaaatcggcgaaaacagggaaggaaaccaagacgacgtccgcatcgaaatggcccgcccccgccgcgtcagacactggatgtacagcccagtaatactaaccatcctggcaataggcttggcagaatcctgcgacgaaatggttcacgcggacagtaaactcgttagctgccgccaaggcagcggcaacatgaaagaatgcgtaaccacggggagagcactactacccgcggtaaaccccggacaagaagcatgcctccacttcaccgcccctggatccccggactccaaatgcctccgcatcaaagtaaagaaaattaacttgaaatgcaaaaggagctccagctatttcgtccccgacgcacggagccgatgcacaagcgtacgccgctgtaggtgggccggcgattgccagtctgggtgcccaccgcactttacaagcaattccttcagcgacgactgggcaggcaaaatggaccgggccgggctcggcttctcaggatgctccgacggatgcggtggagcagcatgcggttgcttcaatgctgccccaagctgcatattttggagaaaatgggtcgaaaacccacacggtatcatttggaaagtcagcccctgtgccgcatgggtcccctcagcagtcatagaactaacaatgcccagcggagaggtacgaacgttccaccccatgagcggaatcccaacacaagtattcaaaggtgtaagcgtgacctacttaggctcagacatggaggtctccgggctgaccgacctttgtgaaatcgaggaactgaaatcgaaaaagctcgcgctagcgccctgcaaccaagcgggaatgggagtcgtaggaaaagtaggggaaatacaatgcagcagtgaagaatcagctcgcaccattaagaaagacggctgcatatggaacgccgacctggtcggaatcgagctacgcgtagatgatgccgtctgctactccaaaattacaagcgtagaagcagtagctaactacagcgccataccaacaaccatcggcggactccgattcgagagatcgcacgacagtcaaggaaaaatctcaggcagccccctcgacataacagcgattagggggtccttcagcgtaaattacagaggcctgcgcctgtccctgtccgagataacagccacatgcaccggagaagtcactaacgtaagcggctgctacagctgcatgacgggagcgaaagtaagcataaaactgcactcttccaaaaactccaccgcacacgtacgatgtaagggagacgaaacggccttcagcgtactggaaggcgtccactcctacaccgtctcactaagtttcgaccacgctgtcgtcgatgaacagtgccaattaaactgcggcggccacgagagtcaggtgaccctaaaaggaaacctcatcttcctagacgtacccaagttcgttgacggctcatacatgcaaacgtaccactcaacagtcccaaccggagcaaatattcctagccccaccgactggctaaacgcactattcggcaacggtctatccaggtggatactgggagtcatgggggtacttttaggaggcctcgccctcttcttcatgatcatgagccttttcaagctaggcacaaaacaagtcttccgaagccgcaccaaactcgcataa

SEQ ID NO: 16510 - RNA, 3222 nt, synthetic construct
  misc_feature 1..3222: note = derived and/or modified CDS sequence (opt11) from SFTSV(HNXY_206)__KC292302.1__GP
  source 1..3222: mol_type = other RNA
atgatgaaggttatatggttcagctctctcatatgcctagtcatccaatgcggcggtgacacaggccccatcatctgcgcgggcccaatccatagcaacaaatcagccgacattccacaccttctggggtactccgaaaagatctgccaaatagacaggctaatccacgtaagctcctggctccgcaaccactctcaattccaagggtacgtaggacaacgcgggggccggagccaagtctcgtactatcccgcagaaaacagctacagccgctggtctggcctgctatcgccgtgcgatgcagactggctaggcatgctagtagtgaaaaaggccaagggaagcgatatgatcgtacccgggccctcctacaaaggcaaagtattcttcgaaagaccgactttcgacggatacgttggttgggggtgcggttcgggcaaaagcaggaccgagagcggggagttgtgctcctcagatagcggaacctcatccggcctactaccctcagacagggttctttggataggcgacgtagcttgccaacccatgaccccgataccggaagaaacctttctagaactcaagagctttagccagagcgagttcccagacatctgcaaaatcgacggcatcgtttttaaccaatgcgaaggcgaaagcctcccccaacccttcgacgtggcctggatggacgtcggacacagccataaaatcatcatgcgcgaacataaaacaaaatgggtccaagaatcgagcagcaaagatttcgtctgttacaaagagggaacaggaccgtgctcggaatcggaagagaaaacgtgcaaaacctccggctcctgccgcggagacatgcagttctgtaaagtggcagggtgcgaacacggcgaggaggcgtccgaagcaaaatgtcgatgcagcctcgtacacaaacccggtgaggtagtagtatcctacggaggcatgcgcgtaagacctaaatgctacggattctcccgcatgatggcgacactcgaagtaagccaaccagagcagagaatagggcaatgcacaggatgccacctcgaatgcattaacggcggcgtccgactgattactctaacaagcgagttaaaaagcgcaaccgtatgcgcatcgcacttctgcagcagcgcgacctcgggcaaaaagagcacagaaatacaattccactcgggatccctcgtaggcaagaccgcgatccacgtgaaaggagccctcgtagacggaaccgagttcacgttcgaaggttcgtgcatgtttccggacgggtgcgatgcagtggactgtacgttctgcagggaatttctcaagaacccgcaatgctaccccaccaagaaatggctattcatcataatcgttatactccttggctacgccgggttaatgctactgacaaacgtactaaaagccataggcgtgtgggggagctgggtcatagccccagtcaaactcgtgttcgcgatcatcaaaaagttaatgcgagcagtctcatgcctcatgggtaagctaatggatcgcggaaggcaagtcatacacgaagaaatcggcgaaaacagggagggcaaccaagacgatatcagaatcgaaatggcgcgaccgagacgggtaagacactggatgtactccccggtcattctgacaatcctagctattggcctcgccgaaggctgtgacgaaatggtacacgccgactcaaaactggtctcgtgccgacaagggagcggcaacatgaaagagtgcgtgaccaccgggagagcactgctgccagcagtgaacccaggacaagaagcatgcctacacttcacaacaccaggaagcccagattcgaaatgtctaaagatcaaggtcaaacgcatcaacctcaaatgcaaaaagtcatcaagctatttcgtgcccgacgcaaggtcaaggtgtactagcgtacgtaggtgtcggtgggcgggcgattgccaaagcggttgcccgccccacttcacatccaacagctttagcgatgactgggcagggaagatggacagggccggcctggggttctccggatgcagcgacggatgcggcggcgcggcctgcggatgcttcaacgccgccccgagttgcatcttttggaggaaatgggtagaaaacccacacggcatcatttggaaagtaagcccctgcgctgcgtgggtcccaagcgctgtgatcgaactcactatgccgagtggggaggtacgcaccttccacccaatgagtggaataccgacccaagtttttaagggcgtctccgtaacatacttaggatcggacatggaagtcagcgggctgacagacttatgcgaaatcgaggaactaaaatccaaaaagctcgcactcgcaccatgcaaccaggccggcatgggggttgtaggcaaggtcggagaaatacaatgtagcagcgaggaaagcgcacgaaccataaagaaagacggatgcatctggaatgcagacctcgtcggaatagaactacgggtggacgatgcagtctgctactcaaagataacctcggtcgaagccgtggcgaactacagcgccatcccaaccaccataggaggactaaggttcgaacgctcccacgatagccaaggaaaaatatcggggtctccactggacatcaccgccataagaggctcattctccgtcaattacagaggcttacgattaagcctaagcgaaataacggcgacctgcaccggcgaagtgacgaacgttagcgggtgctatagctgcatgacaggcgcaaaagtaagcatcaaactacactcgagcaagaactcgaccgctcacgtacgatgtaaaggggacgagacagcgttctctgtcctcgaaggggtccatagttactcagtctccctcagctttgaccacgccgtggtcgacgaacagtgccagctgaactgcgggggccacgaaagtcaagtaactctccgcggaaacctaatattccttgacgttccaaaattcgtcgacggctcttatatgcaaacgtaccacagcacagtcccaaccggggcaaacataccgagccctacagattggttaaatgccctcttcggcaacggcctaagccgatggatacttggagtaataggtgtactactgggagggcttgcactcttctttctcataatgagcctcttcaagctaggaaccaaacagatattccggagtaggacaaagctagcataa

SEQ ID NO: 16511 - RNA, 3222 nt, synthetic construct
  misc_feature 1..3222: note = derived and/or modified CDS sequence (opt11) from SFTSV(HNXY_207)__KC292315.1__GP
  source 1..3222: mol_type = other RNA
atgatgaaggtcatatggttccccagtctaatatgcttcgtaatacaatgcagcggcgactccggtccaatcatatgcgcagggccgatacacagcaataaaagcgcagacatcccccacctactaggatactccgagaaaatctgccaaatagacagactaatacacgtaagttcctggctaaggaaccattcgcaattccagggatacgttggccagcggggcggccgaagccaggtctcatattaccctgctgaaaacagctactcacgatggtcaggcctactctccccatgcgacgctgactggctcgggatgcttgtcgtaaagaaagccaaaggaagcgacatgatcgtgcctggaccatcatataagggaaaggtcttcttcgaacggccaacctttgacggctacgtcggatggggctgcggcagcggcaaaagccggacagaaagcggtgaactgtgctcgagcgattcagggacctcatccggactcctaccatcagaccgagttctatggataggagatgtagcctgccagccaatgacaccaataccggaagaaaccttcctcgagctaaagagcttcagccaaagcgagttccccgacatttgcaaaatagacggtatagtcttcaaccaatgcgaaggggaatccctcccccagccattcgacgtcgcctggatggacgtaggccactcccataaaataataatgcgcgaacacaaaacgaaatgggtgcaagagtcaagcagtaaggacttcgtatgctacaaagaaggaacagggccgtgctcagaaagcgaagagaaaacctgcaaaaccagcggatcatgcaggggagacatgcaattctgcaaggtcgcaggatgcgaacacggagaagaagcctccgaagcaaaatgccgctgctcactggtacacaagccgggtgaagtagtggtgagttacggcggcatgcgggtaagacctaaatgctacggattcagccgcatgatggcaactctggaggtcaaccagccggagcaacgcatcggccaatgcaccggctgccacctagaatgcatcaacggaggcgtgcgcctgataacactaacgtccgagctcaagtcagcgacagtgtgcgcctcacatttctgctcctctgccacgtctggcaagaaaagcaccgaaatacaattccacagcggcagcctcgtgggaaaaacagccatccacgtaaaaggggctctagtcgacggcaccgaatttacattcgaaggatcctgcatgttcccagacggatgcgacgccgtcgactgcacgttttgcagggagttcctcaagaacccacaatgctacccagcgaagaagtggcttttcataatcatcgtcatacttctcggatacgcaggtctcatgttactcaccaacgtcctaaaggcgatcggaatatggggaagctgggtaatcgctcccgtcaaactaatgttcgcgataataaagaaactcatgagaactgtttcctgcctaatggggaaactcatggaccgcggccgtcaggtaatccacgaagaaataggagagaacagagaaggcaaccaagacgacgtccgcatcgaaatggcacgcccaaggcgggtgcgacactggatgtacagccccgtcatattaaccatcctggccataggtttggcagagagctgcgacgagatggtccacgcggactccaaactggtaagctgcaggcaaggaagtgggaacatgaaagaatgcgtcaccacaggccgagccttgctccccgcagtcaacccgggacaggaagcctgcctgcacttcaccgcaccaggcagtccagactcaaaatgcttgaaaatcaaagtcaagcgcataaatctgaagtgtaagaaaagcagctcgtacttcgtaccggacgccaggtccaggtgcaccagcgtacgcagatgcagatgggccggtgactgccaaagcgggtgtccaccccatttcaccagcaactccttctcagacgactgggcaggaaaaatggatagagcaggtctcggcttttccggttgctccgacggatgcggcggcgccgcatgcggttgcttcaacgcggcgccatcgtgcatattctggcgcaagtgggtagaaaacccgcacggcatcatctggaaagtcagcccatgcgcagcatgggtgcccagcgccgtcatagaactcacaatgccaagcggagaggtgcgcaccttccacccaatgtccggaatcccaacccaagtttttaaaggggtgtccgtcacctacctaggctcagacatggaggtctctgggctcacggacctgtgcgaaatagaagaactaaaaagcaagaagctcgcgctggcaccatgcaaccaggccggtatgggagtagtcggcaaagtcggcgaaattcaatgcagctccgaagaaagcgcaagaaccatcaagaaagacggatgtatctggaatgccgacctcgtagggatcgaactaagggtcgacgatgcggtttgttactcaaaaatcacttcggtggaggccgtagccaactacagcgccataccgacgaccatcggaggcctaagattcgaacgctcccatgactcccaaggaaagatatcgggaagccccctagacatcacagcaatacgcggctccttctcagtaaactacagaggccttcgtctatcactaagtgaaataacagcgacctgtaccggcgaagtaacaaacgtatcagggtgctacagctgcatgaccggcgcaaaagtcagtatcaaactacactccagcaaaaactccacagcacacgtacgctgcaaaggagacgaaaccgcattcagcgtcctcgaaggggtgcatagctacaccgtctcactatccttcgaccacgccgtagtagacgaacagtgccaattaaactgcgggggacacgaaagccaggtaacactgaaagggaacctaatattcctcgacgtaccaaaattcgtagacggaagctacatgcaaacataccactcaacggtacctaccggagccaacatcccgagcccaaccgactggctcaacgccttattcggcaacggcctgagccgatggatactcggcgtcattggcgtgctgttaggaggactagcactattcttcatgataatgtcgctattcaaacttggcaccaaacaagtgttcagaagccgaacaaagctagcatag

SEQ ID NO: 16512 - RNA, 3222 nt, synthetic construct
  misc_feature 1..3222: note = derived and/or modified CDS sequence (opt11) from SFTSV(HNXY_224)__KC292317.1__GP
  source 1..3222: mol_type = other RNA
atgatgaaagttatatggttcagctctctcatatgcttcgtcattcagtgctccggagattcgggcccgataatatgcgcagggccaatacactcaaacaaaagcgcagacatcccacacctactaggctattccgagaaaatttgccagatcgaccggctcatacatgtatcctcatggctacgaaaccacagccaattccaagggtacgtaggccaacgaggaggacgaagccaggtgagctactatcccgctgaaaacagctatagccgttggtcaggcctcctctcaccatgcgacgcagactggctcggaatgctagtcgtcaaaaaggccaagggctccgacatgatcgtacccggaccctcctataaaggcaaagtatttttcgaacgccctaccttcgacggatacgtgggatggggctgtggttccggaaaaagccgaaccgaaagtggggaactatgctcatccgacagcggaacatcaagtggcctcttaccctcggaccgcgtcctctggatcggagacgtcgcgtgccaacctatgactccaatcccagaagaaaccttcctcgaactaaagagtttttcccagtccgagttcccagacatctgcaaaatcgacggcattgtattcaatcagtgcgaaggagaatccctcccccaaccctttgacgtcgcatggatggacgtaggccactcacacaagatcatcatgagagaacataaaaccaaatgggtccaagaatcctcctccaaagatttcgtatgctataaagaaggaacaggaccgtgctctgagagtgaagagaaaacatgcaaaacatccggctcatgcagaggagatatgcaattctgtaaggtcgccggatgcgaacacggagaggaagcctccgaagcaaagtgccgctgttcgctcgtacacaagcccggcgaagtggtagtaagctacggagggatgcgcgtacgccccaagtgctacggattctcgcgaatgatggcaacgctcgaggtgaaccaaccggagcaacgaatcggccaatgcaccggatgccacctagagtgcataaacgggggcgtccgactcatcacgttaacatcagaactaaaaagcgcaaccgtctgcgccagccacttctgcagttccgcaacgagcggcaaaaagtcaacggaaatacaattccactcaggctcgctcgtgggtaaaaccgccatccacgtcaagggagccctagtcgacgggaccgagttcacgttcgaaggctcttgcatgttcccggatggatgcgacgcagtcgactgcaccttctgccgagaatttctcaaaaacccccaatgctaccccgccaagaagtggcttttcatcatcgtcgtcatacttctaggctacgccggcctaatgctcctcacgaatgtgctcaaagctataggcatctggggatcctgggtcatagcccccgtaaaactcatgttcgcaatcatcaaaaagctaatgcgcacagtatcgtgcctgatggggaaactaatggaccgcggacgccaggttatacacgaagaaatcggcgagaaccgtgaaggcaaccaggacgacgtcaggatcgagatggcgcgaccacgacgggtccgccactggatgtatagccccgtaatactaaccatactagcaataggcctcaccgagtcatgcgatgaaatggttcacgcagactccaagctcgtgagctgtcgtcaaggaagcgggaacatgaaagagtgcgtcaccaccggacgcgcgcttctaccagccgtaaaccccggacaggaggcctgcctacactttacggcacccgggagcccggactcaaaatgcctcaaaatcaaagttaaacgaataaacctaaaatgtaagaagtcttccagctacttcgtgcccgatgccaggagccgatgcactagcgtacgtaggtgccgatgggcaggagactgcgaaagtgggtgcccaccccacttcacctccaacagcttctcagacgactgggccggcaaaatggaccgcgcaggactcggcttctccggctgctccgacggctgcgggggagccgcctgcggctgtttcaacgcagccccttcatgcatcttctggaggaaatgggtagaaaatccccacggcataatctggaaagtttccccgtgcgccgcctgggtaccctccgccgtgatcgaactaacaatgcccagcggagaagtccgcacgttccaacccatgagcggtatcccaacacaggtattcaaaggagtatcagttacatacctagggtcggacatggaagtctccggtctaacagacctctgtgagatagaggaactgaaaagcaagaaactcgctctcgccccatgcaaccaagcaggaatgggagtcgtaggaaaagtcggcgagatacaatgcagctccgaagaatcagcacgaacaatcaagaaagacggctgcatttggaacgcagacctagtcgggatagaactccgcgtcgacgacgccgtctgctactctaaaatcacctcggtcgaggcagtagccaactacagcgctatccctacaacaatcggaggcttacggttcgagcgcagccacgatagccagggcaaaatctcaggcagccccctagacataacagcaatccgcggatccttctccgtgaactatcgaggactaaggctgagcctaagtgaaataacagccacttgtaccggagaagttaccaacgtaagcggatgctacagctgtatgaccggagcgaaagtgagcatcaaactccactcctccaaaaacagcacagcccacgtgcgctgcaaaggggacgaaaccgcattctcagtcctcgaaggagtccacagctacaccgtgagcctctcattcgaccacgcggtagtagacgagcaatgccaactaaactgcggtggacacgaaagccaggtcacactaaaaggcaacctaatattcctcgacgtcccaaaattcgtcgacggatcttacatgcaaacataccactccaccgtcccgaccggggctaatatacccagcccaaccgactggctaaacgccctcttcggaaatggactaagtagatggatccttggagtcatcggcgtgttattaggcggactagctctattcttcatgataatgagcttattcaaactcggcaccaaacaagtattcagatcaagaacaaaactagcctaa

SEQ ID NO: 16513 - RNA, 3222 nt, synthetic construct
  misc_feature 1..3222: note = derived and/or modified CDS sequence (opt11) from SFTSV(HNXY_231)__KC292313.1__GP
  source 1..3222: mol_type = other RNA
atgatgaaggtcatatggttcagctccctaatctgcttcgtaatacaatgcagcggcgatagcggtccgatcatctgcgccggacccatacactcgaacaagtcagcaggaataccgcacctcctaggatactcagagaaaatatgccaaattgaccgactcatccacgtctccagctggctcagaaaccactcccaattccagggatacgtcggccagcgcgggggtcggagccaggtatcgtactatcccgcagaaaatagctactccagatggagcggcctcctctcaccctgcgacgctgattggctcggaatgctagtcgtcaagaaggccaaaggttccgacatgatagtgcccggaccatcctataagggaaaggttttcttcgaacgccctaccttcgacggctacgtcggctggggctgcggatccggaaagtcacgaactgaatctggggaactatgctcatcggacagcggaacgagctccgggttactccccagtgaccgcgtactatggatcggggacgtagcctgtcagcccatgactccgatccccgaagaaaccttcctcgaactcaaatcattcagtcaatccgaatttccagacatatgcaaaatcgacggaatcgtattcaaccaatgcgaaggtgaaagcctgccgcaacccttcgatgtcgcgtggatggacgtcgggcacagccacaaaatcatcatgagagaacacaaaaccaagtgggtacaagaatccagttcgaaagacttcgtctgctataaagagggcaccggaccgtgctcggagtcagaagagaagacctgcaagacctccggatcgtgccgcggcgatatgcaattctgcaaagtagccggatgcgaacatggggaagaagcctcggaagcaaaatgtcgatgttcattagtccacaaacccggcgaggtcgtagtgagctacggcggcatgcgcgtacgcccaaagtgctacgggttctcacgcatgatggctacactggaagtaaaccagcccgaacaacgtatcggccaatgcacagggtgccacctcgagtgtataaacggaggcgtccgacttatcacccttacatcagaactaaaaagcgctacggtgtgcgcctcacacttctgctcatcagccacatccggaaagaaatccaccgaaatccaattccactcgggtagcctcgttggtaaaacagccatacatgtcaagggcgcgcttgtagacggcacagagttcacattcgagggctcctgcatgttccccgacgggtgcgacgctgtggattgcactttttgccgcgagttccttaaaaacccccaatgctacccagcaaagaaatggttgttcatcataatcgtcatcctactaggctacgccggactcatgctcctaaccaatgtcctaaaagccatcggaatatggggatcatgggtaatcgcacccgttaagttaatattcgcaataatcaaaaagctaatgaggaccgtctcgtgcctgatgggcaaacttatggaccgaggacgacaagtcatccacgaagaaataggagagaaccgcgaaggcaaccaagacgatgtcaggatcgaaatggcacgcccccgccgggttcgtcactggatgtactcccccgtgatactaaccatactggcaattggactagctgaatcatgcgatgaaatggtacacgccgacagcaagctagtatcatgcagacagggctccgggaacatgaaagaatgcgtcactacaggccgtgccctgttacccgccgtgaatccaggccaagaagcctgcctgcacttcaccgcgcccggctcccccgactcgaaatgtctgaagataaaagtaaagcgaataaacttaaaatgcaagaaaagctcctcctacttcgtccccgacgcaagaagccgatgcaccagtgtccgccgatgtagatgggccggagattgccaaagcggatgcccgccacacttcaccagcaactcattctccgacgactgggccggaaaaatggaccgcgcggggctcggtttctcgggatgctccgacggctgcggcggagcggcctgcgggtgcttcaacgcagcgccatcctgcatcttctggcgcaaatgggtcgaaaaccctcatggcataatatggaaagtctccccctgcgccgcctgggtccccagcgccgtaatagaactcaccatgccctctggcgaagtccggacattccacccaatgtccggcataccaacgcaagtattcaaaggagtctctgtcacgtacctcggatccgacatggaagtgagcggactcaccgacctttgcgaaatagaagaactcaaatccaagaaactagcactagcgccctgcaaccaagcaggcatgggcgtcgtagggaaagtaggagagatacaatgcagttcagaagagtccgcccgaacaatcaagaaagacggttgcatctggaacgccgatctggtcggtatcgaactacgagttgacgatgccgtctgctacagcaaaataacgtccgtcgaagccgtcgcaaactactcagccatacctacaacaatcggcggcctgcgcttcgaacggtcacatgactcacaaggcaaaatctccggaagcccacttgatataacggcaatacgtggatccttcagcgttaactaccgcggactcaggctaagcctatcagaaataaccgcaacatgcaccggggaagtcaccaacgtatcagggtgctactcctgcatgaccggcgcaaaagtctcgataaaactgcactcaagcaaaaactccaccgcacacgtacgctgtaaaggcgacgaaacggccttttcggtcctcgaaggcgtgcacagctacacagtcagcctatcgttcgaccatgcggtagtcgacgaacagtgccaactcaactgcggcggccatgaatcgcaagtaaccctcaaaggcaacctcatcttcctagacgtacccaaattcgtcgacggaagttatatgcaaacttaccactccaccgtcccaacgggagcgaacataccaagcccaaccgattggctcaacgcacttttcggcaacggcctctcacgctggatactaggggtcatcggcgtactccttggagggctcgcactattcttcatgatcatgagcttattcaaactaggaacaaagcaagtcttccgtagccgcaccaaactcgcatag

SEQ ID NO: 16514 - RNA, 3222 nt, synthetic construct
  misc_feature 1..3222: note = derived and/or modified CDS sequence (opt11) from SFTSV(HNXY_245)__KC292320.1__GP
  source 1..3222: mol_type = other RNA
atgatgaaagtgatttggttcagctcactcatatgtttcgtaatacaatgcagcggcgacagcggcccaataatatgcgcgggcccaatccactccaacaaatctgccgacataccccacttactcgggtacagcgagaagatatgccaaatcgacagattaatacacgtctcctcatggttgagaaaccattcacaattccaaggatacgtaggacaacgaggtgggaggtcccaggtaagctactaccccgcggagaactcatatagcagatggagcgggctgctcagtccttgcgacgcagactggctaggaatgttggtagtgaaaaaggcaaagggaagcgacatgatcgtaccgggaccaagctataaggggaaagtcttcttcgaaaggccgaccttcgacgggtacgtaggatggggatgcggaagtggaaaatcaagaacggaatcaggagaactctgcagctcagactcgggaacaagctccgggcttctcccctcaaaccgggtcctctggatcggcgacgtagcatgtcagccgatgacacccatcccagaagaaacctttctggagctcaaaagttttagtcagtccgaatttccggatatttgcaaaatcgacggtattgtcttcaaccaatgcgaaggagaaagcctcccccagcccttcgacgtcgcctggatggacgtcgggcactcccacaaaataatcatgcgagaacacaaaacaaaatgggtgcaggaaagcagtagcaaagacttcgtatgctacaaagaaggcacaggaccctgctcggaatcagaagagaaaacatgcaaaacatcaggctcatgccgaggagatatgcagttctgcaaagtagccgggtgtgaacacggggaagaagccagcgaagccaaatgccgctgcagcctagtacataagccaggggaggtcgtcgtctcatacggcggcatgcgtgtccgacccaaatgctacggattcagccgcatgatggcgacactcgaagtaaaccaacccgaacaacgcatagggcagtgcacaggctgccacctcgagtgcatcaacggaggcgtaaggctaatcacgctaacctcagagcttaagagcgcaacggtctgcgcatcccacttctgctccagcgccacaagcggaaagaaatccaccgaaatccaattccacagcggaagcctcgtgggcaaaacagccattcatgtaaaaggcgcattagtcgacgggaccgagttcaccttcgaaggctcatgcatgttcccagacggttgcgacgccgtagactgtaccttttgccgggagttccttaaaaacccacagtgttacccagccaagaaatggctattcatcataatcgtaatactactcgggtacgccggacttatgttactcacaaacgtgctcaaagcaataggtatatggggaagctgggtgatagcacccgtaaaactaattttcgctatcataaagaaactcatgcgaaccgtatcctgcttaatggggaaactgatggaccgggggagacaagttatacacgaagaaataggagaaaaccgagaagggaatcaggacgacgtgcgcatcgaaatggcacgaccacgacgggtcagacactggatgtactcccctgtgatccttaccatcctcgccatcggcttagcagaaagctgcgacgaaatggtacacgcggactccaaacttgtgagctgcagacagggctccggcaacatgaaagaatgcgtaacaaccgggagagccttgctcccagccgtaaacccgggacaggaagcctgcctacacttcacagcacccggatctccagactccaaatgcctgagaatcaaagttaagcgcatcaacttaaagtgcaagaaatccagcagctacttcgtaccagacgcacggtcaaggtgcacctccgtgcgacgatgtagatgggctggcgattgccagagcggttgcccaccccacttcacatccaacagtttctcagatgactgggcaggaaaaatggacagagccggactggggtttagcggctgtagcgacggctgcggaggagcagcatgcggatgcttcaacgccgcaccatcctgcatcttctggcgcaaatgggtcgaaaacccgcacggcatcatatggaaagtatcgccctgcgccgcgtgggtgcccagcgccgtaatcgaactaacaatgccaagcggggaagtaagaacattccaccccatgtcaggcatcccgacccaagtcttcaaaggagtatccgtaacctacctaggcagcgacatggaagtcagcgggctcacggacttatgcgaaatcgaagaactcaaaagcaaaaagctagcgctcgccccatgcaaccaagccgggatgggagttgtcggtaaggtcggggaaatccagtgctcctcagaagagagcgcccggaccataaagaaagacggctgcatctggaacgcagatctagtagggatcgagttgcgggtcgacgacgcagtatgctactcaaaaataacctcagtcgaggctgtcgccaactactcagcaatcccaaccaccataggaggcctcaggtttgaacgaagccacgacagccaaggcaaaatctccggcagcccactcgacatcaccgctataaggggcagcttcagcgtaaactatagggggctacgactcagcctgagcgaaatcacagcaacatgcaccggcgaagtcaccaacgtaagcggctgctacagttgcatgacaggagcaaaagtaagcatcaaacttcatagcagtaaaaacagtaccgcacacgtgcgatgcaaaggtgacgagacagccttcagcgtactggagggagtacacagctacacaataagcctcagcttcgaccacgcggtggtggacgaacaatgtcaactaaactgcgggggacacgaatcccaagttaccctaaaaggtaacctgatcttcctagacgtccccaagttcgtcgacggctcttacatgcaaacctaccactccacagtcccaacaggggcgaacatcccgagcccgaccgactggctgaacgccctcttcggcaacggactatcacgatggatactaggggtaatgggtgtcctactcggcggactggcactattcttcatgataatgagcctcttcaaactcgggacgaaacaagtgttcagaagccgcaccaaactagcctaa

SEQ ID NO: 16515 - RNA, 3222 nt, synthetic construct
  misc_feature 1..3222: note = derived and/or modified CDS sequence (opt11) from SFTSV(HNXY_262)__KC292309.1__GP
  source 1..3222: mol_type = other RNA
atgatgaaagttatctggttttcctccctcatatgcttcgtaatacaatgcagcggcgactcgggcccaatcatatgtgccggccccatccattccaacaaatcagccgacatcccgcatctgctcgggtactccgagaaaatctgccaaatagacagactcatccacgtaagcagctggttacgcaaccactcacagttccaaggctacgtcggccaacgcggcggaagatcccgggtatcctactacccggcagagaacagttactcacgatggtcaggactactctcaccatgcgacgcagactggctaggcatgctagtggtgaaaaaggctaaaggcagtgacatgatcgtcccaggtccatcatacaaaggtaaagtcttcttcgaacgcccgaccttcgacggctatgtcggctggggctgtggctctggcaagagccgcacagaaagcggggaactctgctcaagcgacagcggaacctcctcaggcctactaccatctgatcgagtactctggataggcgacgtagcatgtcaacccatgacaccaattcccgaagagacctttcttgaactcaagagcttcagccagagcgagttcccagacatctgtaaaatagacggaatagtattcaaccagtgcgaaggcgagagcttaccccaaccattcgacgtagcatggatggacgtgggccacagccacaaaataatcatgcgcgaacacaaaacgaaatgggtacaagagtcctcaagcaaagactttgtgtgctacaaagaaggcacaggaccctgctcagaatccgaagagaaaacgtgcaagacctcgggctcatgcagaggagacatgcaattctgcaaagtagccggatgtgaacacggagaagaagcgagcgaagcaaagtgccgctgctccctggtacataaacccggagaagtggtcgtctcatacgggggcatgcgagtacgaccgaaatgctacggattcagtcgaatgatggccaccctcgaagtaaaccagccagagcaaagaatcggacaatgcacggggtgccacctagaatgcattaacggaggcgtacgcctgatcaccctcaccagcgagttaaaatcagcaaccgtttgcgcctcccatttctgctcatcagccacgtccggtaaaaagtcgacagaaattcaattccactccggctctctcgtgggcaaaaccgccatacacgtcaagggagcgctcgtagacgggactgagttcacattcgaaggatcctgcatgttccccgacggatgtgatgctgtcgactgtaccttctgccgcgagttcctcaagaacccacaatgctacccagcaaagaaatggctgttcatcataatagtaatattactgggctacgcaggacttatgcttctcaccaacgtcctcaaagcaataggtatatggggctcatgggtaatcgcaccagtaaaacttatcttcgcaataatcaagaaactcatgcgcactgtttcctgcctaatgggcaaactcatggataggggacggcaggttatacacgaagaaatcggagagaacagggaaggaaaccaagacgacgtccgcatcgaaatggcccgtccacgccgagtgagacactggatgtatagtcccgtcatactgacaatcctcgccataggactggccgaaagctgcgacgaaatggtccacgcagactcaaaattagtatcgtgccggcaagggtccggaaacatgaaagagtgcgtcaccaccggcagagccctactcccggccgtaaacccgggccaagaagcgtgcctgcacttcacggctcccggctcgcccgacagtaaatgcctaaaaataaaagtcaaaagaataaacctgaaatgcaagaaaagttcaagctacttcgttccagacgccagaagccgatgcacctccgtcagacgctgccggtgggccggtgactgccagtcgggctgtcctccccacttcacgtccaatagtttttccgacgactgggcaggcaaaatggaccgtgcaggactcgggttcagcggatgctcggacggatgcggaggggcagcatgtggatgcttcaacgccgcccccagctgcatattctggagaaaatgggttgaaaacccacacggcataatctggaaagtatcaccctgcgccgcctgggtaccgtcagccgtaatcgagctcacaatgcccagcggggaagtgcgcacattccaccccatgagcggtatccccacgcaagtctttaaaggagtcagcgtcacctacctcggaagcgacatggaagtctccggactgacagacctatgcgagatagaagaactgagaagcaagaaactcgcgctcgcaccatgcaaccaggcaggaatgggcgtcgtaggaaaagtgggcgaaatacagtgttcaagcgaagaatccgccagaaccataaagaaagacggctgcatttggaacgcagaccttgtcggcatagaactacgagtcgacgacgcggtatgctacagcaaaataacatccgtcgaagcagtagccaactactccgcaatacccacgacaataggcggactccggttcgagcgctcacacgacagccaaggaaaaatatctggctcacccttagatatcaccgccatacgaggatccttcagcgtgaactaccgcggtctgcgactctcactgagcgaaataacagctacctgcacaggagaagtcacaaacgtcagtggatgctatagctgcatgacgggcgccaaggtatcaataaaactccactcaagcaaaaacagcactgcccacgtgcgatgcaaaggggacgagaccgccttcagcgtcctcgaaggcgtccactcatacaccgtatcactcagctttgaccacgcagtagtggacgaacaatgccaactcaattgtggcggacacgaatcccaagtcacactcaagggaaacctaatattcttggacgtccccaagttcgtagacggctcctacatgcaaacctaccactccaccgtccccaccggcgcgaacataccctcccccaccgactggctcaacgccctcttcggcaacggtctcagccgctggatactcggagtcatgggcgtcctgctgggcggcctagccctcttcttcatgataatgagcctctttaagctcggcaccaaacaagtgttcagaagccgtaccaagctagcctaa

SEQ ID NO: 16516 - RNA, 3222 nt, synthetic construct
  misc_feature 1..3222: note = derived and/or modified CDS sequence (opt11) from SFTSV(HNXY_278)__KC292322.1__GP
  source 1..3222: mol_type = other RNA
atgatgaaagtaatctggtttagctcactcatatgcctcgtgatacaatgcggcggggataccggcccaataatctgtgccggcccaacccacagcaacaaatccgcagatattccccatctgctaggatactcggaaaagatctgccaaatcgacagactaatccacgtaagctcatggctccgaaaccactcccaattccaaggatacgtaggccaacgaggcgggagaagccaagtatcgtactacccagcggagaacagctactcccgatggagcgggctactcagtccgtgcgacgcagattggctagggatgctcgtcgtgaaaaaggcaaaaggtagcgacatgatcgttcccggaccctcctacaaagggaaagtcttcttcgaaaggccaacattcgacggctacgtgggctggggctgcggctcgggaaaaagccgcacagagagcggcgaactatgcagcagcgacagcgggacctctagtggtctcctcccatcggacagggtgctatggatcggagacgtagcatgccagcccatgacaccaatcccagaagaaaccttcctcgaactcaagagcttttcccagagcgagttcccagacatttgcaaaatagacggcatagtattcaaccaatgcgaaggagaaagtctaccacaaccattcgacgtcgcatggatggatgtaggacactcccacaaaatcataatgagggagcacaaaacaaagtgggtacaagaatcttcatcgaaggatttcgtgtgttataaagagggaacaggcccgtgcagcgaatcagaggagaaaacctgtaaaacgggcggctcctgccgaggtgacatgcaattctgcaaagtagcggggtgcgaacacggcgaagaagccagcgaagccaaatgtaggtgctcgctcgtccacaaacccggagaagtggtggtaagctacgggggaatgcgagtcagaccgaaatgctacgggttctctcgaatgatggcgacattggaggtgtcccaacccgaacaaagaatcggacagtgcacaggatgccatctagaatgcataaacggcggagtccgactgatcacactaacatcagaactaaagtccgccaccgtctgcgctagccacttctgcagctcggccaccagcggcaagaaaagcacagaaatacaattccactccggaagcctagtcggaaaaaccgcaattcacgtgaaaggcgccctagtcgacggaacagagttcacctttgaaggatcatgcatgttcccagacggctgcgacgcagtagactgcacattctgccgggagttcctcaaaaacccccaatgttatccagctaagaaatggctattcatcatcatcgtcatcttattagggtacgccggactgatgctgctaaccaacgtactgaaagccattggtgtatgggggagctgggtcatcgcccccgtcaagctcgtgtttgccatcatcaagaaactaatgcgggcagtctcctgcctaatgggtaaacttatggaccgcggccgccaggtcattcatgaagaaataggtgaaaaccgagagggaaatcaagatgacgtacgtatcgaaatggcacgcccacgccgcgtcaggcactggatgtacagtccggtcatactcaccatactggccatcggactggcggaaggctgcgatgaaatgatccacgccgactcgaaactcgtatcatgcagacaaggatccggaaacatgaaagaatgcgtaaccacgggcagagccctcctccctgcagtgaacccgggccaggaagcctgtctacacttcacagcacccggatcaccagactcaaaatgcctaaagataaaagtcaaacgaataaacctaaagtgcaagaaaagctcaagctacttcgtcccagacgcgcgcagtaggtgtacaagcgttagacgatgccgatgggccggcgactgccagtccggttgcccaccgcacttcacgccaaacagcttcagcgacgactgggctgggaaaatggacagggcaggccttggattcagcggctgcagcgatggctgcggcggggctgcctgcggttgcttcaacgcggcaccaagctgcattttctggcggaaatgggtcgaaaacccccacgggatcatctggaaggtaagcccatgcgcagcatgggtaccctcagcagtaattgaactcacaatgcccagcggagaagtgcgtaccttccacccaatgtcaggtataccaacacaggtattcaaaggggtatcggtaacatacttaggttcagacatggaagtgagcgggctcacagacctatgcgaaatagaggaactcaaaagcaagaaactcgcgctagccccatgcaaccaagcagggatgggagtcgtaggcaaagtaggcgaaatacaatgcagctcggaggaaagcgcacgaaccataaagaaagacggctgtatctggaacgcggatctagtgggaatcgaacttagagtagacgatgcagtctgctacagcaaaataacgagcgtcgaagccgtagccaattatagcgccatacctacaacaataggcggcctcagattcgaacgatcacacgactcccaaggcaaaatctccggcagccctctagatatcacggccatcagagggtcattcagcgtcaactaccgcgggctgcgtctgtcactcagcgaaatcaccgcgacctgcacgggagaagtaacaaacgtaagcggatgctatagctgcatgacaggcgcgaaagtgagtataaaactacactcatccaagaactcaacagcacacgtacgatgtaaaggcgacgaaaccgcattctcggtcctcgaaggagtacactcctattcagtgagcctctccttcgaccacgccgttgtagacgaacagtgccagctaaactgcggtggccacgaaagccaagtcaccctccggggaaacctaatattccttgacgtaccgaaattcgtagacggctcctacatgcaaacctaccacagcacagtcccgaccggagccaacataccatcacccacagactggctgaacgcactcttcggcaacggactcagccgctggatactcggagtgatcggggttctactgggaggactggccctctttttcctaatcatgagcctcttcaaactcggcaccaaacaaatcttccgttcccggaccaaacttgcgtga

SEQ ID NO: 16517 - RNA, 3222 nt, synthetic construct
  misc_feature 1..3222: note = derived and/or modified CDS sequence (opt11) from SFTSV(HNXY_31)__KC292310.1__GP
  source 1..3222: mol_type = other RNA
atgatgaaagtcatctggttctctagtttaatatgcttcgtcatccaatgcagcggagactccggaccaataatatgcgcaggcccgatccactccaacaaatccgctgacataccgcacttgctgggatactccgaaaagatctgtcagatagaccgactcatccacgtcagcagttggctacgaaaccattcgcaattccaaggatacgtgggccagcgaggaggacggtcccaggtatcctattaccccgcggaaaattcctactcccgctggagcgggctactgtccccatgcgacgcagactggctcgggatgctggtagtgaaaaaggcgaagggctccgacatgatagtaccaggcccctcctacaaaggcaaggtattcttcgagagaccgaccttcgatggctacgtaggctggggctgcggatccggaaagagcaggaccgaaagcggggaactatgctctagcgacagcggaacctcaagcgggctactcccctcggaccgcgtactatggataggagacgtggcctgccaaccaatgacccccatcccagaagaaacgttcctagaactcaagtcgttctcacaaagtgagttccccgacatctgcaagatcgacggtatagtcttcaaccaatgcgaaggcgaaagcctccctcagccctttgacgtagcatggatggatgttggacacagccacaaaatcatcatgcgtgaacacaaaaccaaatgggtacaagaaagcagctcaaaagacttcgtgtgctacaaagagggcacaggcccgtgctcggaatccgaagagaagacgtgcaaaacttcgggctcctgcagaggtgacatgcaattctgtaaggtggccgggtgcgaacacggagaagaagcatcagaggccaagtgcagatgcagcttggtacataaaccgggcgaagtagtcgtaagctacgggggcatgcgcgtccgcccaaagtgctacggattctccagaatgatggcgacactggaggtgaaccagcccgaacaaagaatcggccaatgcaccggctgccacctggaatgcataaacgggggcgtgcgccttatcacactgacctctgaacttaagtccgcgactgtctgcgcaagccacttctgctcctcagcaactagcggcaaaaagagtacagaaatccaattccactctggaagcctggtcggaaaaaccgcaatccacgtgaaaggagctctagtagacggcacagagttcacattcgaaggctcctgcatgttccccgacggatgcgatgcagtagactgcaccttttgtcgcgagttcctcaaaaacccgcaatgctacccagccaagaaatggctattcattataatcgttatcctactcggatacgccggacttatgctactcaccaacgtcctcaaagccataggaatatgggggtcatgggtcatagcacccgtaaaactcatattcgcaatcatcaagaaactaatgcgaacggtctcctgccttatgggaaaactaatggaccgagggcgtcaagtaatacacgaagaaataggtgaaaaccgggaaggaaaccaggacgacgtcagaatcgaaatggcgcgaccccgacgggtccggcactggatgtacagccccgtaatcctcacaatcctagcaatcggactcgccgagagctgtgacgaaatggtccacgcagactccaagctagtctcctgccggcagggaagcggaaacatgaaagagtgcgtcaccacgggcagagccctcctcccagcagtcaacccaggccaggaagcgtgcctacacttcaccgcgcccggctcccctgactctaaatgcctcaaaataaaagtaaaaagaataaacctgaaatgcaagaaatcctcgagctacttcgtacccgacgcacgatcacggtgcacaagcgttcgccgatgtcgatgggcgggcgattgccaaagcggatgtccaccccacttcacatcaaacagcttctccgatgactgggctgggaaaatggaccgagccggtctgggattctcaggttgtagcgacggatgcggcggcgcagcatgcggctgcttcaatgctgcaccgagttgcatattttggcgcaaatgggtcgaaaacccccatggcatcatatggaaagtatcaccgtgcgccgcgtgggtaccctcggctgtaatagagctcacaatgcccagcggcgaggtacgaaccttccaccccatgagcggaatcccaacccaagtattcaaaggagtcagcgtcacctatttaggatccgacatggaagtcagcggactcaccgacctctgcgagatagaagaactcaaatcaaagaaactagccttagcgccctgcaatcaagcaggtatgggggtcgtcggtaaagtaggagagatccagtgcagctcagaagagagtgcacgcacaatcaagaaagatggatgcatatggaacgcagacctcgtggggatcgagctaagggtcgacgacgcggtctgctactccaaaataacatcggtcgaggcagtagccaattacagcgcgatccccaccaccataggcgggctacggttcgaacgcagccacgacagccaaggcaaaatctcagggtcaccattagacataacagccatccgcggttcattctcggtcaattaccgaggcttacgactcagtctatcagaaatcacagccacgtgcacaggagaagtaacaaacgtaagcgggtgctacagctgcatgaccggcgcaaaagtaagcatcaaattgcactccagcaaaaactccaccgcacacgtgagatgcaaaggagacgagaccgcattctcagtactagagggagtccactcctatagcgtatcactctcattcgaccacgcagtggtcgatgaacagtgccagctaaactgcgggggccacgaatcacaagtaaccctccgcggcaacctgatattcctcgacgtccccaaattcgtcgacggcagctacatgcagacgtaccactccaccgtaccaacaggagcaaacatccccagcccaacagactggctcaacgcactcttcggaaacggcttaagccggtggattctaggcgtcataggggtcctgctaggcggcctagcattgttcttcatgataatgtctctcttcaaactggggaccaaacaagtattcagatctagaacaaaactagcttag

SEQ ID NO: 16518 - RNA, 3222 nt, synthetic construct
  misc_feature 1..3222: note = derived and/or modified CDS sequence (opt11) from SFTSV/FTLSV(2011YGS5)__KF711925.1__GP
  source 1..3222: mol_type = other RNA
atgatgaaggttatatggttcagcagcctagtgtgcttagtcatacaatgcagcggagactcaggccccatcatatgcgctggccccatacacagcaacaaaagcgcagcaatcccacacctcctcgggtacagcgagaaaatctgccaaatagacagacttatacatgtcagctcgtggctgagaaaccactcccagttccaaggctacgtagggcaacgcggaggcagaagccaagtcagctactacccggccgaaaacagctatagcagatggtcagggctattaagtccgtgcgacgccgactggctcgggatgttggtagtaaagaaagcgaaaggatcagacatgattgtaccaggaccctcatacaaaggaaaggtattcttcgaaaggccaacattcgacggctatgtcggatggggatgcggttccggaaagagtaggacagagagcggcgaactttgcagtagcgacagcggaacatcgagtggccttctacccagcgaccgcgtactatggatcggcgacgtagcgtgccagccaatgacacccatcccagaggagaccttcctcgagttaaagagcttctcgcaatccgagttcccagacatctgtaaaatcgacggaatagttttcaaccagtgcgaaggcgaaagcctcccccaacccttcgacgtagcgtggatggacgtaggccactcacacaaaataatcatgcgggaacacaaaacaaaatgggtccaggaaagcagcagcaaggacttcgtatgctacaaagagggcaccggcccgtgctcagaaagcgaggaaaaagcgtgcaagacaagcggctcatgccggggcgacatgcagttctgcaaagtcgcaggatgcgaacatggggaagaagcctccgaggcgaaatgccgctgctccctagtacacaagccaggagaagtagtcgtaagctacggaggcatgcgggtacgacccaaatgctacggcttctcaagaatgatggcaaccatggaggtcaacccaccagagcaacgcatcggacagtgcacggggtgccacctcgagtgcatcaacggaggagtacgcttgataaccctaaccagcgagctcaaaagcgcaaccgtctgcgccagccacttctgcagctccgcaacaagtggaaagaaaagcaccgaaatccacttccactcaggaagcctggtagggaaaacagcaatacacgtgaaaggagcgctggtagacggtacagagttcaccttcgaaggctcatgcatgttcccagacggttgcaatgcagtagactgcacattctgcagggagttcctaaagaacccgcagtgctaccccgcaaagaagtggctatttatcatcatagtaatactactgggatacgccggtctgatgctcctgacaaatgtactaaaggcaatcggagtatggggaagttgggtcatcgcccccgtcaaactcatgtttgcgatcatgaagaaactgatgcgcacggtcagctgcttggtcgggaaactgatggaccgtggacgccaagtaatccatgaagagattggagaaaacggggaagggaaccacgacgacgtaagaatcgaaatggcgagaccccgccgagtcagacattggatgtacagcccagtaatactaaccattctcgccatagggctcgccgagggctgcgacgaaatggtgcacgcggactcaaaactggtatcctgcagacaggggagcggcaacatgaaagaatgcgtgacaaccggtagggccttactcccagccgtaaacccgggacaagaagcatgcctgcacttcaccgcgccaggatctccggactcaaaatgcctgaaaatcaaagtaaaacgaatcaacctaaaatgcaagaaaagcagcagctacttcgtccctgacgcacgcaaccgttgcacatcagtaagacgctgtaggtgggcgggagactgccaaagtggatgtcccccacacttcacgagcaacagctttagcgacgactgggcaggaaaaatggacagggcaggactaggattcagcggctgcagtgacggctgcggcggagcggcatgcggatgcttcaacgccgccccatcatgcatattctggcgcaaatgggtcgagaactcacacggaatcatctggaaagttagcccgtgcgccgcatgggtcccgtccgcagtaatcgaactcacaatgccatcaggtgaagtacgcacgttccaccccatgagcggcataccgacacaagtcttcaagggggtgtcagtcacatacttaggctcggacatggaggtaagcggactaacagacctgtgcgaaatcgaagaactgaaaagtaaaaagctcgccctggcgccgtgcaaccaagcagggatgggggtcgtaggcaaagtgggcgaaatccagtgcagcagcgaagagagcgcaagaacaattaagaaagacggatgcatctggaacgcagacctagtcggcatcgaactacgggtagacgacgcggtatgctactccaaaatcacgagcgtggaagcagtcgcgaactacagcgccatccccacgaccataggtggcctgcgcttcgaacggagccacgacagccagggcaaaatatcgggctcccctctagacataaccgcgatacgaggatccttctcagtcaactacagaggtctccgactaagcctgagtgagataaccgctacgtgcacgggcgaggtaactaacgtaagcggatgttactcatgcatgacaggcgccaaggtgagcattaaactccacagtagcaaaaactcaacagctcacgtccggtgcaaaggcgacgagacagccttcagcgtcctcgaaggagtacacagctatacggttagtcttagcttcgaccatgccgtggtggatgaacagtgccagttaaactgcgggggacacgagtcacaagtgactcttaaagggaacctaatattcttagacgtccccaaattcgtcgatgggagctacatgcaaacctaccattcaactgtcccgaccggcgccaacatccccagccccaccgactggctcaatgccctgttcggcaacggactctcaaggtggatactgggcgtcataggcgtactgctaggaggactcgcgctgttcttcctaataatgttcctattcaaattagggaccaagcaagtattccggtcacgaacaaaattagcctag

SEQ ID NO: 16519 - RNA, 3222 nt, synthetic construct
  misc_feature 1..3222: note = derived and/or modified CDS sequence (opt11) from SFTSV/FTLSV(2011YGS7)__KF711922.1__GP
  source 1..3222: mol_type = other RNA
atgatgaaagtcatctggttctcatcgctagtctgcctggtcatccaatgcagcggagatagcggaccaatcatatgcgcaggtccaatacatagcaacaaatcagccgcaataccgcacctactaggctacagtgaaaagatctgccaaatagaccgactaatacacgtgagcagctggctgcgcaaccactcgcaattccagggatacgtgggccagcgaggaggtagaagccaggtatcatactaccccgccgaaaactcgtacagtagatggtcaggcctcctctcgccctgcgacgcagactggctgggcatgctcgtcgtaaagaaggcaaagggatcggacatgatcgtgccaggaccgtcctacaagggcaaagtattcttcgaacgacccacattcgacggatacgtaggatggggctgcggatccggcaaaagccgaacagagagcggagaactgtgctccagcgacagcgggacatccagcggactgctaccctccgaccgggtactatggataggcgacgtagcctgtcaacccatgaccccaataccagaagaaacatttctagaactcaagtcatttagccaatccgaatttccagacatatgcaagatagacggtatcgtattttaccagtgcgaaggagaaagtctaccccaaccatttgacgttgcctggatggacgtcggtcactcgcacaaaataataatgagggaacataaaactaaatgggtgcaggaatcgtcatcaaaggacttcgtctgctacaaagaaggaacaggcccatgctccgaaagtgaagagaaagcatgcaaaacgagtggctcatgccgaggcgatatgcaattctgcaaggtcgccggatgcgagcacggagaagaagcctctgaagccaaatgtaggtgcagcctcgtacacaaaccaggcgaagtcgtcgtatcatacggagggatgcgagtcagaccaaagtgctacgggttcagcagaatgatggccacaatggaggtgaacccgccagaacagcgcatagggcaatgcaccggctgccacttagagtgcatcaatgggggtgtcagactaataaccctaacatcagagctcaagagtgcaacagtatgcgcaagccacttctgctcctcagcaacaagcgggaagaaatccactgaaatacacttccactcgggtagcctcgtcgggaaaaccgcaatacacgtcaaaggagcattggtggacgggacagagttcacatttgaaggcagctgcatgttccccgacgggtgcaacgcggtcgactgcacattttgccgcgaatttcttaaaaatccccaatgttacccagcgaagaaatggctattcataataatagtcatactcctaggatacgcaggcctaatgttactgacaaacgtgctaaaagcaatcggcgtatggggcagctgggtgattgcacctgtcaaacttatgttcgcaataatgaagaaactcatgcgaacagtcagctgcctagtcggaaaacttatggaccgcggaagacaagtaatacacgaagaaataggagaaaacggagaagggaaccatgacgacgtgaggatcgaaatggcccgcccaagaagagtcaggcactggatgtacagcccggtgatcctcactatattggccataggcctagcagaaggctgcgacgaaatggtacacgcagacagtaagctcgtctcctgccgacaaggcagcgggaacatgaaggaatgcgtaaccacagggcgcgccttgctcccgtcggtgaacccaggacaagaagcatgcttgcactttaccgccccaggaagcccggattcaaagtgcctcaagatcaaggtaaaacgaatcaacctaaaatgtaagaaatcctcgagttacttcgtgcctgacgcgaggaaccgatgcacaagcgtgaggcgctgcagatgggcaggagattgccaaagcggctgcccgccccacttcacgagcaacagcttctccgatgattgggctggaaaaatggaccgcgccggcctcgggttcagcggatgcagcgacggatgcggcggggcagcgtgcggatgcttcaatgcggcacctagctgcatcttctggaggaaatgggtagaaaactctcacgggataatctggaaagtctcaccatgcgcggcttgggtacccagcgccgtcatcgagctgaccatgccaagtggtgaagtcagaacgttccacccaatgagcgggataccaacacaagtattcaagggagtgtcggtcacatacctaggctcagacatggaagtatccggcctaacagacctgtgcgaaatcgaggaactaaaatcaaagaagctcgccctcgcgccctgcaaccaagccggaatgggcgtagtgggaaaagtcggtgaaatacaatgctcctcagaagaaagcgcacggacgatcaagaaagacggatgtatatggaatgccgacttggtcggcatcgaactacgagttgacgacgcggtctgttactcaaaaataaccagcgtagaagccgtggccaactactctgccatccccacgaccataggagggctcaggttcgagcgctcacatgacagccaaggtaaaataagcggctcaccactagacataaccgcgatacgaggctcattctcagtaaattaccgaggactccgcctaagcctctccgaaataacagccacatgcacaggcgaggtaacgaacgtcagcggctgctacagctgcatgacgggcgcgaaagtcagcatcaagctacactcaagcaaaaattcaacagcccatgtgcgttgcaaaggtgacgagacagcattttcggtactggaaggggtccacagctacaccgtaagtctcagcttcgaccacgcggtggttgacgaacagtgccaactcaattgcggaggccacgaaagccaagtaaccctgaaaggaaacctgatctttctggatgtcccgaaattcgtagacggatcatacatgcagacataccactccacagtcccaacgggtgcaaacataccaagcccgaccgactggctcaacgcgctattcggaaacggactaagccgctggatactcggggtaatcggcgtactcttaggcggcctagcacttttcttcctaatcatgttcctattcaaactcggaactaagcaagtcttccgatccagaacaaagctcgcgtaa

SEQ ID NO: 16520 - RNA, 3222 nt, synthetic construct
  misc_feature 1..3222: note = derived and/or modified CDS sequence (opt11) from SFTSV/FTLSV(2011YPQ11)__KF711926.1__GP
  source 1..3222: mol_type = other RNA
atgatgaaggtcatctggttcagcagcctcgtatgcctagttatccagtgcagcggagactcgggccccatcatatgtgctggccctatacatagtaacaagtccgccgcaataccccacctactcggctattcagagaaaatctgccaaatcgacagactaatacacgtgagctcttggctcagaaatcactcacaatttcaaggatacgtgggacagcgcgggggacgatcccaagtgtcatattaccccgcggaaaactcctacagccggtggtccggcctcttatccccctgcgatgcagactggctgggaatgctcgtggtcaaaaaggccaaggggtcagacatgatagttcccgggccaagctacaaaggaaaagtcttcttcgaacgcccaaccttcgacggatacgtcggctggggctgcggctccggcaaatccagaacggagtcgggtgaactgtgttcttcggacagtggaacatcatccgggttactcccgtccgaccgcgtgctgtggatcggcgacgtcgcgtgccaaccaatgacacccatcccagaagaaacattcctagaattaaaatcattctcacaaagtgagttccctgacatatgcaaaatcgacggtatcgtattcaatcaatgcgaaggtgaaagcctacctcagcccttcgacgtcgcctggatggatgtcggacactcccacaaaattattatgcgagaacacaaaaccaagtgggtacaagaatccagctcaaaagacttcgtatgctacaaagaagggacaggcccatgctcggaatccgaagagaaagcgtgcaaaaccagcggcagctgccgaggggacatgcagttctgcaaggtggctggctgcgaacacggagaggaagccagtgaagccaaatgccgttgctccctcgtacacaaacccggagaagtcgtcgtctcctacggagggatgcgcgttcgccccaaatgctatggatttagcagaatgatggcaaccatggaggtcaatccacccgaacaaagaataggccaatgcaccggatgccacctcgaatgcatcaacggaggcgtccgcctcatcacactcacctccgaactaaaaagcgcaaccgtgtgcgcatcgcacttctgcagctcagctacctccggaaagaaaagtacggaaatccacttccattctggctcactcgtcggcaaaaccgctatacacgtcaaaggcgctctagtagacggaaccgagttcaccttcgagggcagctgcatgttccccgacgggtgcaatgcagtggactgcacattctgccgcgagttcttaaagaacccccaatgctacccagcgaagaaatggcttttcatcataatcgttatcctgttaggctacgctgggctaatgttactaacaaacgtactaaaagcgatcggggtatggggatcatgggtcatcgcacctgtaaaactcatgttcgccattatgaagaaacttatgcgaaccgtctcctgcctagtcggaaaactgatggaccggggtagacaagtaatccacgaagaaatcggcgaaaacggcgaaggcaaccacgatgacgtacgcatcgaaatggcccgaccgagaagggtaagacactggatgtacagccctgtaatactaacaattctggccatcggcctcgccgagggttgtgacgaaatggtacacgcagactcgaaactcgtatcctgtagacaagggtccgggaacatgaaagaatgcgtgaccacgggacgagcgctcctaccctccgtcaacccgggacaggaagcatgcctacacttcacagcccccggatccccggactcgaaatgcctgaaaatcaaagtcaaacgaataaacctcaaatgcaagaaaagctccagctacttcgtccccgacgcccgctaccgttgcacaagcgtaaggagatgcccttgggcgggagactgtcagtccgggtgcccgccacacttcacaagtaatagcttctcggacgactgggccgggaaaatggaccgtgcgggactcggcttcagcggttgcagtgacggctgtggaggagcggcatgtggctgcttcaacgccgcaccatcttgtatcttctggcgtaaatgggtcgaaaactctcacggaatcatatggaaagtctctccctgcgccgcctgggtaccatcagcggtaatcgaactaacaatgccgagcggcgaagtccgcacattccatccaatgagcggaatcccaacccaggtcttcaaaggcgtaagcgtcacctacctaggctccgacatggaggtctcaggattaaccgacctctgcgaaatcgaggaactcaaatcgaaaaagctagccctggcaccctgtaaccaagcgggcatgggagtcgtaggcaaggtgggcgaaatacagtgcagctcagaagaaagcgcacgcacaatcaaaaaggacggatgtatatggaacgccgacctagtcggcatcgagctcagggtcgacgacgcggtatgctacagcaaaatcacctcggtggaagccgtcgccaactacagcgcaatccccactaccattggcggactcaggttcgaaagatcccacgacagccagggcaagatatcggggtcgccactcgacataacagcaatacgaggctccttctcagtaaactacaggggcctccgcttaagcctaagcgagataactgcaacctgtacgggggaagtaaccaacgtgagcggatgctacagctgcatgacaggcgccaaagtaagcataaaactccacagcagcaaaaactcgaccgcgcacgtcagatgcaaaggcgacgaaaccgccttctcagtcctcgaaggagtccacagctacaccgtaagcctgtccttcgatcacgccgtcgtagatgaacaatgccagctgaactgcggaggccacgaatcccaggtgaccctaaagggaaacctgatcttcctcgacgtgcccaagttcgtcgacggttcctatatgcaaacatatcactcaaccgtcccaaccggcgcaaatatccccagcccaaccgactggctgaacgcactcttcgggaacggcatgtcacgatggatactaggggtaataggcgtcctgctcggagggctagcactattcttcctcataatgttcctgttcaaactagggaccaaacaagtgttccgctccagaacgaaactggcataa

SEQ ID NO: 16521 - RNA, 3222 nt, synthetic construct
  misc_feature 1..3222: note = derived and/or modified CDS sequence (opt11) from SFTSV/FTLSV(2011YPQ12)__KF711930.1__GP
  source 1..3222: mol_type = other RNA
atgatgaaagtcatatggtttagctcactcatatgcttcgttattcagtgcagcggggatagcggcccgatcatatgcgcgggacccatccactcaaacaagtccgctgacatacctcacctactcggatactcagagaaaatctgccaaatagacagactaatacacgtatcaagctggctacgcaaccactcacagttccaaggatacgttggacaacgaggcggccgcagccaggtatcatactacccggcagaaaacagctacagccgttggtccggcctcctgtccccctgcgacgccgattggctggggatgctcgtagtcaaaaaggctaaaggctcagacatgatcgtacccgggccaagttacaagggaaaggtcttcttcgaaagaccaaccttcgacggatacgtgggctggggatgcggaagcggcaaaagccgtacggaaagcggagaactctgctcgtccgatagcgggacctcgtccggacttctacccagcaaccgtgtcctctggataggcgacgtagcgtgccagcccatgaccccaatccccgaagaaacattcctcgaacttaagagttttagccagagcgagttcccggacatctgcaagatcgacggaatagtcttcaaccagtgcgagggcgaatcactaccccagccattcgacgtagcatggatggacgtaggacactcacacaaaatcataatgagagaacacaaaacgaaatgggtacaagaatccagcagcaaagacttcgtttgctataaagagggaacgggcccatgctccgaaagcgaggagaaaacatgcaaaacatctgggagctgcagaggcgacatgcagttttgcaaagtagccggatgcgaacacggagaagaggcctcggaagcaaaatgccgatgctcactcgtacacaaacctggcgaagtagtagtcagttacggaggtatgcgagtacgcccgaaatgttacggattctcgcgcatgatggcgacactcgaagtaagccaacccgagcaacgaatcgggcagtgtaccgggtgccacctagaatgcatcaacggaggcgtccgactgataacactaacgagcgaactgaagtccgccaccgtatgcgcgagccatttctgtagctccgcgacctcggggaagaaaagcacggagatacaatttcactcaggatccctagttgggaaaaccgccatccacgtcaaaggcgcgctcgtcgacggcacagagttcactttcgaaggctcgtgcatgtttcctgatggctgcgacgctgtagactgcaccttctgccgagaatttctgaaaaacccacaatgctaccccgccaagaaatggctattcatcataatcgtcatactccttggatacgccggcctgatgctgctgacaaacgtactcaaagcaatcggcgtatggggcagttgggtcatcgcaccggtaaagctcgtattcgcaatcatcaaaaagctaatgagagcagtgtcatgcctcatgggcaaactcatggaccgcgggcgacaagtgatccacgaagaaataggcgaaaacagggaagggaaccaagacgacgtgcgcatagaaatggcgcgaccccgaagggtaagacactggatgtacagccccgtgatattaactatcctagccatcggactggcagagggctgcgacgagatggtccacgcagactcgaaactcgtgagctgcagacagggctccggcaacatgaaggaatgcgtaacaacgggcagggcacttctcccagcagtcaacccaggacaagaagcgtgcttgcacttcacggcgcccgggagccccgacagtaagtgccttaaaataaaggttaaaaggataaacctgaaatgcaaaaagtcaagctcatatttcgtacccgtggccaggtaccgatgcacaagcgtgcgccggtgcagatgggcaggcgactgtcaaagcggatgcccaccgcacttcacgagcaacagctttagcgacgactgggccggaaaaatggacagagccggactgggattctcaggatgcagcgacggctgcggcggggcagcgtgcgggtgcttcaacgccgcgccatcctgcatcttctggagaaaatgggtcgaaaacccgcacgggattatttggaaggtatcgccatgtgccgcgtgggtaccatcggccgtgatcgaactcacgatgccatccggagaagtacgcacattccaccccatgagcggaataccaacacaagtcttcaaaggagtctccgtcacatacctgggctcagacatggaagtcagcggactaacggatctctgcgagatcgaagaactaaaaagcaagaaattagcactcgctccctgtaaccaagccggcatgggtgtagtggggaaagtcggagagatacagtgcagctccgaagaaagcgcacgaacaattaaaaaggacggctgcatctggaacgccgacttagtcggcatcgagctgagagtagatgacgcagtctgctactcgaaaatcacgtcagtggaagccgtggccaactactcagccatacccacgaccatagggggtctcaggtttgaacgctcacacgacagtcaaggaaaaatatccgggagcccactagacatcaccgcaatccgcggctcgttctccgtgaactaccgcggcctacggttgagcctgagcgaaataacagcaacgtgcacgggggaagtgaccaacgtaagcggctgctacagctgcatgacgggtgctaaagtgagcatcaaactgcactcgtccaaaaactcgaccgcacacgtgagatgcaaaggagacgagaccgcgttctcagtactagaaggggtacattcctatagcgtcagcctcagcttcgaccacgcagttgtagacgaacaatgccaactaaactgcggcggtcatgaatcacaagtgaccctaagaggcaacttaatattccttgacgtcccgaaattcgtggacggatcatacatgcaaacataccactcgacagttccaacaggggcaaatataccgagccccacagactggctcaatgcgctattcggcaacggactgagcagatggatactcggagtcataggggtacttctaggcggcttagccctgttcttcctcatcatgtcactgtttaagctaggcactaaacagatcttcaggagcagaaccaagctagcatga

SEQ ID NO: 16522 - RNA, 3222 nt, synthetic construct
  misc_feature 1..3222: note = derived and/or modified CDS sequence (opt11) from SFTSV/FTLSV(2011YPQ17)__KF711923.1__GP
  source 1..3222: mol_type = other RNA
atgatgaaggtaatatggtttagctccctagtgtgcctggtaatacaatgcagtggtgactcaggcccgataatctgtgcaggcccgatccacagtaacaaaagtgccgccatcccgcacctcctcggatacagcgagaaaatttgccaaatcgacagactcatacacgtaagctcatggctacgaaaccactcgcaatttcaaggatacgtgggtcagcggggaggcaggagccaagtgtcgtactaccccgcagaaaactcatacagccgatggtcaggactactttcgccctgcgacgccgactggctcggaatgctcgtggtcaagaaagccaaaggctcagacatgatagtcccagggccatcatacaagggcaaagtcttcttcgaacgccccaccttcgacggatacgtaggatggggatgcggctctggcaaaagccggaccgaaagtggagaactgtgctcaagcgactcagggacttcatccggcttactgccctcagacagagttctgtggataggcgacgttgcgtgtcaacccatgacaccaatcccagaagaaacctttctagaactgaaatcattcagccaaagcgagttcccagatatatgcaaaatagacggaattgtattcaaccaatgtgagggcgagagcctcccccagcccttcgacgtggcgtggatggacgtcggacatagccacaagatcatcatgcgcgagcataaaacgaaatgggtacaagaatcaagctctaaagacttcgtatgctataaggaaggaacgggcccatgctccgaatcggaagagaaggcgtgtaaaaccagtggttcatgtagaggagacatgcagttctgtaaagtcgctgggtgcgaacacggggaagaggccagcgaagccaaatgtaggtgcagcctggtccacaaaccaggcgaggtagtagtatcatatgggggcatgcgcgtacgaccaaaatgctacggattctcccgcatgatggcaaccatggaagtaaacccacccgagcaaaggatagggcaatgcacaggctgccacctggagtgcatcaacggtggagtccgcctaatcacgctgacaagcgagctgaaaagcgcaaccgtgtgcgcatcccacttctgcagctcggccacgagcgggaaaaagagcacggaaattcattttcattcaggctcgctagtaggaaaaaccgcaatccacgttaagggagctctagtagacgggaccgagttcacgttcgaaggtagctgcatgttcccggacggatgcaacgcattagactgcacattctgccgagagttcctcaagaacccccactgctatcccgcaaagaaatggctattcatcattatcgtcatactactcggctatgcaggcctaatgctacttacaaacgtactgaaagcgataggcgtatggggcagctgggtaatagcaccggtaaaactaatgttcgcgatcatgaagaaactcatgcgcacggtcagctgcctcgtagggaaactaatggaccggggccgccaagtcatacacgaagagatcggggagaacggggagggtaaccacgatgacgtcagaatcgagatggcacgtccacgacgagtcagacactggatgtacagccccgtaatcctaacgattctagccatagggttagcggagggatgcgacgagatggtccacgctgactcaaaactggtatcgtgccgacagggaagcggaaacatgaaagaatgcgtaaccaccggacgagccctcctcccttccgtaaaccccggacaagaagcctgcctccactttaccgcgccaggctctccagactcaaaatgcctcaagataaaagtcaagcgcataaatctcaaatgtaagaaaagctcaagttactttgtaccagacgccagaaacagatgcaccagcgtgaggcgctgccgctgggcaggcgactgccaaagcggttgtcccccacacttcacgagcaactcattcagcgacgactgggcgggaaaaatggacagagccggcttaggattcagtggctgcagcgacggctgcggaggcgctgcgtgcgggtgctttaatgccgcgccaagttgcatcttttggagaaaatgggttgagaactcgcacggaataatatggaaagtaagcccctgcgccgcgtgggtcccctcggcagtcatagaactcacgatgccatccggagaagtccgcacatttcacccaatgagcggaatcccgactcaggtcttcaaaggggtctcggtaacatatctgggcagcgacatggaagtctcaggactgacggacctttgcgagatcgaggagctgaaaagcaaaaagctcgcactcgccccctgcaaccaggccggtatgggggtagtcggaaaagtcggcgaaatacaatgcagcagcgaagagtcagcgcgcacaataaagaaagatggctgcatctggaacgcggaccttgtcgggatcgagctcagggtagacgacgcagtctgctactcaaaaatcacctcagtggaggcggtagcaaactactccgccattcccacaaccataggcgggctccgattcgaacgctcacacgacagccagggcaagatatcgggatcgccattggacattacagcaatacgaggatccttcagcgtaaactatagagggttacgcctcagcctctctgagatcacggcaacatgtacgggcgaagtaacgaatgtgagtgggtgctactcctgtatgacgggcgcgaaagtaagcataaagctgcactcgagcaaaaactcaaccgcccacgtacgctgcaaaggcgacgagacagcattctcagtactggaaggagtccacagctacacagtaagtctctcattcgaccacgcggtggttgacgaacagtgtcaactaaactgcggtggacatgaaagccaggtcaccctgaaagggaacctgatcttcctagacgtccccaagttcgtcgacggtagctacatgcaaacataccactcgacggttcccacaggggcaaacataccctctcccaccgattggctgaacgcccttttcggcaacggcctcagccgatggatcctaggcgtaataggcgtcctgctgggaggactcgcacttttcttcctcattatgttcctgttcaaactcggtacaaaacaagtcttccggagcaggaccaagttagcataa

SEQ ID NO: 16523 - RNA, 3222 nt, synthetic construct
  misc_feature 1..3222: note = derived and/or modified CDS sequence (opt11) from SFTSV/FTLSV(2011YSC22)__KF711927.1__GP
  source 1..3222: mol_type = other RNA
atgatgaaagtaatatggttcagtagccttgtgtgcctagtcattcaatgctcaggagacagcggaccgatcatatgcgcgggcccaattcattcaaacaaatcagccgccataccacacctcctaggatactcagagaaaatctgccagatagaccggctcatccacgtaagttcctggctgcgcaaccactcccaatttcaagggtacgtcggacagcgcgggggaaggtcacaagtctcgtactaccccgcggaaaacagctactcccgctggagcgggctactgtcaccatgcgacgccgactggctcggcatgcttgtagtcaagaaagccaaaggatcggacatgatagtaccgggacccagttacaaaggaaaagtgttcttcgaacgccccaccttcgacgggtacgtaggatggggttgcggctcaggcaaatccagaaccgaaagcggagaactatgctcatcagactccggaacaagcagcggcctcctaccaagtgacagagtcctatggataggtgacgtcgcgtgccagccaatgacccccattcccgaagaaaccttccttgaactaaagagtttcagccaaagcgagtttccggacatctgcaagatagacggaatagttttcaaccaatgcgaaggcgaatcactcccacaacccttcgacgtcgcatggatggacgtcgggcatagccacaagattataatgcgggaacacaaaaccaaatgggtccaggaatcttcatccaaagacttcgtatgctacaaggaaggcacgggaccgtgctccgaatcagaggaaaaagcatgcaaaacctcagggtcatgcaggggcgacatgcagttctgcaaagtggccgggtgcgaacacggagaagaagcctcagaagcaaaatgtcgatgcagcctagtccacaagccaggcgaggtagtagtatcatacggcgggatgcgggtccgcccaaaatgctacgggttctcccgcatgatggcaaccatggaagtaaatcccccagagcagcgtatcggccaatgcaccggctgccacctagagtgcataaacggaggggtgcgactcatcacattgacatccgagctcaaaagcgccaccgtctgtgccagccacttttgcagtagcgccacgagcggtaaaaagagcacggaaatacacttccatagcggctccctcgtgggaaaaacagcaatccacgtcaaaggcgcgctcgtggacggaacagagttcacgttcgaaggctcatgtatgtttccggacggctgcaacgccgtcgactgcacattctgcagggagttcttaaagaacccccagtgctaccccgccaagaaatggctgttcatcataattgtaatcctcctaggatacgccggcctcatgctcctaacaaacgtgctaaaggcgatcggcgtatgggggagctgggtcatcgcaccggtaaaacttatgttcgcaataatgaagaaactaatgcgcaccgtgtcatgtttggtcggtaaactgatggacagagggcgccaagtgatacacgaagaaataggtgagaacggggaaggcaaccacgacgacgtaagaatagagatggcacgaccacgacgggtcaggcactggatgtacagcccagtgatactcacaatactggcaatcgggctcgccgaaggctgcgacgaaatggtacacgcagacagcaaactcgtctcctgtaggcaaggcagcggaaacatgaaagaatgcgtgacaacaggccgggccctcctcccaagcgtcaatccgggccaggaagcatgccttcatttcacggcgccaggctcgccggacagtaaatgcctaaagataaaagtcaagcgcatcaacgtcaaatgcaagaaatcatcaagctatttcgtgcccgacgcccggaaccgatgcacatccgtaagaagatgcagatgggcaggcgactgccaaagtgggtgcccgccccatttcacctccaacagcttctcagacgactgggccggaaaaatggacagagccgggcttggtttttccggatgcagcgacggctgcggaggggccgcatgcggatgcttcaacgcggcgccttcctgcatattctggagaaaatgggtagaaaactcccatggaatcatctggaaagtatccccgtgcgccgcgtgggtcccatccgcggtcatcgaactaactatgcctagcggcgaggtgcggacgttccatcccatgtccggaatcccaacccaggtgttcaaaggggtttcggtcacctacttgggctcggacatggaagtgagcggcctgacggacctgtgcgaaatagaagaacttaaaagcaagaaactcgcattagcaccttgcaatcaagcaggcatgggagtcgtagggaaagtaggcgaaatccagtgctcctcagaagaatccgcgcgcacaatcaagaaagacgggtgcatctggaatgcggacctagtcggaatcgaactcagagtcgacgacgccgtctgctactcgaaaataacgtctgtggaagctgtagccaactactcagccataccaacaaccatagggggactacgcttcgaaagatcacacgactcccaaggcaaaatatccggatcgccgctagacataaccgcgatcagaggatcgttctccgtcaactaccgaggtctgcgcctctccctgagcgaaatcacagcgacatgtacgggcgaggtcaccaacgtgagcggatgctacagctgtatgacaggagccaaagtatcaataaaactccactccagcaaaaactcaaccgcgcacgtaagatgcaagggcgacgaaacagcattctcagtcctagaaggagtccacagctataccgtgtccttatcgttcgaccacgccgtcgtagacgaacagtgccaactcaactgcgggggacacgaatcccaagtcacactcaaaggcaacctaattttcctggacgtaccaaaattcgtcgacggcagctatatgcaaacataccactctactgtgccgacaggggccaacatcccaagcccgacagactggctaaacgcgctcctcggcaacggcatgtctaggtggatcctaggagtcataggagtcctattaggaggactcgccctgttcttcttaattatgttcctattcaagctcggaaccaaacaggtgttcaggagtcggacgaaacttgcatga

SEQ ID NO: 16524 - RNA, 3222 nt, synthetic construct
  misc_feature 1..3222: note = derived and/or modified CDS sequence (opt11) from SFTSV/FTLSV(2011YSC60)__KF711945.1__GP
  source 1..3222: mol_type = other RNA
atgatgaaggtcatctggttcagctcactcatatgcctagtcatacagtgtggaggggacacaggccccataatatgcgcgggcccgatacacagcaacaaaagcgcagacataccacacctactcggttacagcgagaaaatatgccaaattgaccggctcatccacgtctcctcatggctacgaaatcacagccaattccaaggctacgtaggacaacgaggcgggagaagccaagtctcatactaccctgcggaaaacagctatagcagatggtccggactgcttagcccatgtgacgcagactggctaggaatgctcgtagtcaagaaagcaaaaggatctgacatgatcgtgcccggacccagctacaaaggcaaagtctttttcgaaagacccaccttcgatggatacgtaggctggggttgcggcagcggcaagagcaggaccgaaagcggagaactatgttcctcagacagcgggacctccagcggcctcctcccctcggacagagtcctgtggataggggacgtagcatgccagcccatgacccccatcccagaagagacattcctagaactgaaatccttcagccagagcgagttcccggatatatgcaaaatagacgggatagtcttcaaccagtgcgaaggagaaagcctaccacaaccattcgacgtcgcctggatggatgtaggccactcgcacaaaataatcatgagggaatacaaaacgaaatgggtccaggaatctagctcgaaagacttcgtctgctacaaagaaggtacagggccgtgctcagaatccgaagagaaaacgtgcaaaaccagtggttcctgcagaggagacatgcaattctgcaaggtggcaggctgcgaacatggcgaagaagcctctgaagcaaaatgtcgatgcagcctagtacataaaccgggcgaagtcgtcgtcagttacggaggcatgagagtacgcccaaagtgctacggattctcgcgaatgatggcgacactcgaagtaaaccaacccgagcaacggatcgggcaatgcactggctgccacctcgagtgtataaatgggggcgtccgcttgataacccttacatcagagctcaagagcgccacagtatgcgccagtcacttctgctcaagcgccacgagcggaaagaaaagcacggaaattcaattccactccggatcactcgtgggaaaaacagcaatccacgtgaaaggcgcactggtcgacggcacagagttcaccttcgaaggttcgtgcatgttcccagacggctgcgacgccgtagactgcacattctgccgggaatttctcaaaaacccccaatgctaccccgcaaagaaatggctctttataataatcgtaattcttctcggctacgcgggactaatgctgctcacaaacgtgctcaaagctattggcatctggggaagctgggtaatagcgccagtcaaactgatattcgccattataaagaaactcatgcgcactgtctcgtgcctaatgggcaaactcatggaccgaggccgacaggtaatacatgaggaaataggagaaaaccgggagggaaaccaagatgacgtaagaatagaaatggcgcgaccaagaagggtacggcactggatgtacagcccggtcatacttaccatattagcaataggcttagccgaaagctgcgacgaaatggtgcacgcagacagcaaactcgtgtcctgccgacaaggcagcggaaacatgaaagaatgcgtgacaaccggcagggccctcctgccggcagtcaacccaggccaagaggcatgcctacacttcaccgcccccggatcaccagacagcaaatgcctacggatcaaagtcaaacggatcaacctcaagtgcaagaaatcatccagctacttcgtgccggatgcccgcaacagatgcacaagcgttagacgctgtcggtgggccggcgattgccagagcggctgcccgccccacttcacctctaactcgttcagcgacgactgggccggaaaaatggacagggccggattaggcttcagtggatgcagcgatggatgcggaggagctgcatgcggatgtttcaacgcagcaccgagctgcatattctggcgaaaatgggtagaaaacccgcacggaataatatggaaagtatcaccctgcgcggcgtgggtcccgagcgcagtaatcgaactcacaatgccaagcggagaagtgcgtacattccaccccatgagcggaatacccacccaagtcttcaaaggggtatccgtcacttacctcgggtccgacatggaagttagcgggctcacagacctatgcgaaatagaagaactaaaatcaaagaaactcgcactcgcaccgtgcaaccaggcaggcatgggggtagtaggaaaggtcggcgaaatacaatgttcaagcgaggaaagtgctcgtacaataaagaaagatggctgtatatggaacgcggatctagtagggatagagctccgagtcgacgacgcagtctgctactcaaaaataacctccgtagaagccgtagccaactacagcgccatacccacaaccatcggaggtctacgattcgaacgatctcacgacagccaagggaaaataagcggatccccgctagacataacagccatcaggggctctttctcagtaaactacagaggactgaggctctcgttaagcgaaatcacggcgacctgcacaggcgaagtcacaaatgtcagcggatgttatagctgtatgacaggagctaaagtgagcataaaactccattcaagcaaaaactccactgcgcacgtcaggtgtaaaggggacgagacagccttctcagtactagaaggggtgcactcgtatactgtaagcctaagttttgaccacgcagtggtggatgaacaatgccaactaaactgcggaggtcacgaaagccaagttacattaaaagggaacctcatatttctagacgtcccaaaatttgtcgacggaagttacatgcaaacataccacagcacggtaccgacaggggcaaacatcccctccccaacggactggctaaacgcactcttcggaaacggcttaagtagatgggtcctgggggtaatgggcgtactactcggagggttagccctcttcttcatgatcatgagcctgttcaagctgggcacgaaacaagtattccgcagcaggaccaaactagcctaa

SEQ ID NO: 16525 - RNA, 3222 nt, synthetic construct
  misc_feature 1..3222: note = derived and/or modified CDS sequence (opt11) from SFTSV/FTLSV(2011YSH45)__KF711947.1__GP
  source 1..3222: mol_type = other RNA
atgatgaaagtaatctggttcagcagtctcatatgcttcgtcatacagtgctccggagacagcggccccatcatttgcgcgggaccaatacattcaaacaagtcagcagatatcccacacctccttggctacagcgaaaagatctgccaaatagacaggctcatccacgttagcagctggctccgcaaccactcccaattccaggggtatgtaggccaacgcgggggcagatcccaagtgtcttactacccagccgaaaattcctacagcagatggtcaggcctgctaagcccatgcgacgccgactggctagggatgctagtagtgaagaaagcgaaaggaagcgacatgatcgtgccaggaccgtcatataaagggaaagtcttcttcgagcgacccacattcgacggctacgtgggctggggctgcggatcagggaaaagcagaaccgagagcggagaactatgcagcagcgacagcggaacatcgagtggtctactaccttcggacagggtactgtggattggcgacgtcgcctgccagccaatgacacccatcccagaagaaaccttcttagagctaaaatctttcagccaaagcgagttcccagacatatgcaaaattgacggaatcgtattcaaccaatgcgaaggtgaatcactgccccaaccctttgacgtagcatggatggacgtaggacattcccacaaaatcataatgcgagaacacaaaacaaaatgggtccaagaatctagctcaaaagacttcgtctgttacaaagaaggaacaggaccctgcagcgaatcagaagagaaaacctgcaaaacaagcggcagctgccgcggagacatgcaattctgtaaagttgcgggttgcgaacacggcgaggaagcaagcgaagcaaagtgtaggtgctcccttgtccacaagcccggagaagtagtagtatcctacggcggcatgcgtgtacggccaaagtgttatggattctcccggatgatggcgaccctggaagtaaatcagccagaacagagaataggacaatgtacgggctgccacctcgaatgtatcaacggaggcgtccgactcataaccctaacctcagagttaaagagcgcaacagtgtgcgctagccacttttgcagctcagccacaagcggcaagaaaagcacagaaatccaattccactccggctcactcgtaggtaaaacggcaatacacgtaaaaggcgcgctagtcgacggcacggagttcaccttcgaaggatcctgcatgttcccagacggatgcgacgcagtcgactgcacgttctgcagagagttcctcaaaaacccccaatgctaccccgcaaagaaatggctattcatcattatcgtaatactgctcggctacgcaggactaatgcttctaactaacgtgctcaaagccataggcatatggggctcatgggtaatagccccagtaaaactaatctttgccatcatcaaaaagctaatgcgtaccgtcagctgcctgatgggcaaactcatggacagagggagacaagtcatccacgaagaaataggagaaaaccgcgaagggaaccaagacgacgtaagaatcgaaatggcccgcccacgccgggtccggcactggatgtactcccctgtgattctcacgatcctggccatcgggctagccgaaagctgcgacgaaatggtacacgcagactccaaactggtgtcttgtcgccaggggagcgggaacatgaaagaatgcgtcactaccggcagagccctgctaccagcagtaaatcccggccaagaagcatgcctccacttcacggcgcccggatcacccgactcaaaatgcctcaaaataaaggtgaagcgcataaacctcgaatgcaaaaagagcagctcctacttcgtgccagacgcaaggaacagatgtacaagcgtaagacggtgtcgctgggcaggagactgccagtcgggttgtccaccccatttcacaagcaactccttcagtgacgactgggcaggcaaaatggaccgcgccggactaggattctcgggatgctcagatggatgcgggggcgcagcctgtggctgcttcaacgccgcccccagctgcatattctggcgaaaatgggtcgaaaaccctcacggaatcatatggaaagtgagcccctgtgccgcctgggtccccagcgccgtcatcgaactaactatgccaagcggagaagtccgaacgttccaccccatgtccggcatccccacccaggtcttcaaaggagtctcagtaacatacctaggctccgatatggaggtaagcggactaaccgatctttgcgagatcgaggaactcaagtcaaagaaactcgccctggctccatgcaaccaagccggcatgggagtagtcggcaaggtcggcgagatccaatgcagctcagaagagtccgcccgaaccatcaagaaagacggctgcatctggaacgcagacctcgtaggaatcgagctgcgagtagacgacgccgtctgttactcaaaaatcacatcggtcgaagctgtggccaactactcagccatacccacaaccataggcggtctgcgattcgaaagaagccacgacagtcaaggaaaaatatcaggatcgccactagacataaccgccatccgcggctcattctccgtaaactaccgagggctgcgactaagcctatccgaaatcacggccacgtgcacaggagaagtcaccaacgtcagcggatgctatagctgcatgacaggagccaaagtgagcattaaattgcactccagcagaaactcgactgcacacgtgcgttgcaagggagacgaaaccgcgttctcggtcttagaaggcgtacactcctataccgtctcactatccttcgatcacgcagtagtcgatgaacagtgccaactcaattgcggcgggcatgaatcgcaagtgacactgaaaggaaacctaatcttcctagatgttcccaaattcgtcgacggttcatacatgcaaacatatcattcaaccgtccccaccggagcaaacataccgtccccaacggactggctgaacgcgctattcggaaacggactgagccgatgggtcctaggagtcatgggcgtgctactaggagggctagcactcttcttcatgataatgtcactcttcaaactcggcaccaagcaagtattccgttcaagaaccaaactggcctga

SEQ ID NO: 16526 - RNA, 3222 nt, synthetic construct
  misc_feature 1..3222: note = derived and/or modified CDS sequence (opt11) from SFTSV/FTLSV(2011YSH52)__KF711928.1__GP
  source 1..3222: mol_type = other RNA
atgatgaaagtcatatggttcagtagcctcatatgtctggtcatacaatgcggaggcgacacaggaccgataatctgcgccggcccaatacacagcaacaaatctgccgacataccacacctactgggctacagtgaaaagatatgccagatagacaggctaatccacgtctcaagctggctgcgcaaccactctcagttccagggctacgtcggccaaagaggagggcgctcacaggtctcgtactacccagccgagaacagttactccaggtggagcggtctgctaagcccctgcgacgcggactggctcgggatgcttgtcgtaaagaaagcaaaaggctcagacatgatagtacccgggccctcatacaaaggaaaagtcttctttgaacgccctacattcgatggttacgtaggatggggctgcggaagcggcaaatcacgcaccgaaagtggcgaactttgctccagcgactccggaacatcctcaggactactcccctcagacagggtactctggatcggagatgtcgcatgccaacccatgacccccatcccagaagagacgttcctggagctcaagagcttcagccagtcagagtttccggatatctgcaagatagacgggatagtcttcaatcaatgcgagggggagagcttgccacaacccttcgacgtcgcctggatggatgttgggcattcacataagatcatcatgcgagaacacaaaaccaagtgggtccaagaaagctcatcaaaagacttcgtctgctacaaagaaggcaccggaccatgcagcgagagtgaagagaaaacctgcaaaacctcaggctcgtgccgcggagacatgcaattctgcaaagtcgcaggttgtgaacacggggaagaagcgagcgaagcgaaatgccgatgcagcctggtacacaagcccggcgaagttgtggtaagctacggagggatgcgagtacgtcccaaatgctatggattcagcagaatgatggcaacactcgaagtatcccaacccgaacaacggatcggacaatgcacaggctgccacctagaatgcataaacggaggagttagactgatcaccctcaccagcgaactcaaaagcgcaactgtgtgcgcatcccatttctgcagcagcgccaccagcggcaaaaagagcaccgaaatacaattccactcaggctctctcgtcggaaagacagcaattcacgtcaaaggcgcattagtggacggaaccgaatttacgttcgaaggctcctgcatgttccccgacggatgcgacgcagtcgactgcacattctgccgcgagttcctcaaaaacccccaatgctacccagcaaagaaatggctctttatcatcatagtcatcctgctgggctacgcaggattcatgctactcactaacgtcttaaaagcaatcggcgtatgggggtcatgggtgatagcaccagtaaaactggtcttcgccataataaagaaactcatgagagccgtctcatgcctaatgggcaaactcatggaccgcggacgccaggtcatacacgaagaaatcggcgaaaacagagaaggtaaccaggacgacgtaaggatcgaaatggcacgcccacgacgggtacggcactggatgtacagtccggtaatattgactatactagccataggcctagccgaaggatgcgacgaaatggtacacgcagactcgaaattggtaagttgccgccaaggatccgggaacatgaaagaatgcgtaactaccggacgggcactactgccagccgtgaacccaggacaagaagcatgcctccacttcaccgcacccggatcgccggacagcaaatgcctaaaaataaaagtcaaaaggataaacaagaaatgcaagaaaagctcgagttacttcgtgccggacgccaggtaccggtgcaccagcgtacgacggtgtcgatgggccggagactgtcaatcaggatgcccaccacacttcacctccaacagcttcagcgacgactgggcgggaaaaatggaccgcgcaggactcgggtttagcggctgctccgacggatgcggcggagcagcctgcgggtgtttcaatgcagctcccagctgcatcttctggcgaaaatgggtagaaaacccacacggaatcatctggaaagtctcgccctgcgccgcctgggtcccatccgccgtcatcgaactaacgatgccctctggagaagtaaggacgttccacccaatgtccgggattcctacgcaggtcttcaaaggcgtcagcgtaacatacctgggcagcgacatggaagtcagcggtctgtccgacctatgcgaaatcgaagaactaaacagcaagaaactcgcactagccccctgcaaccaagccggaatgggagtcgtagggaaagtgggcgaaatccaatgcagcagcgaggaatccgcacgcacaataaagaaagacggctgcataaggaacgcagacctcgtcggcatcgaggtgcgagtcgacgatgcagtattctacttcaaaataactagcgtcgaagccgtagcaaactacagcgcgattcccacgaccataggcggattacggtttgaacgatcacacgacagccaaggcaaaatttccggatcacccctagacataacagccatacgaggcagcttcagcgttaactaccgcggacttcgactctccttgtccgagatcacagcgacctgcaccggagaagtcacaaatgtaagcgggtgctacagttgcatgactggggcgaaagtatccatcaaacttcacagcagcaagaacagcacagcacacgtaagatgcaaaggggacgagacagcatttagcgtgctcgagggggtacacagctactccgtatccctatcgttcgaccacgccgtagtagacgaacaatgccaactaaactgcggagggcacgaatcgcaagtgaccctacgaggaaatctaatcttcctggacgtgccaaaattcgtcgacggctcatacatgcagacataccacagcaccgtaccgacaggggccaacatacccagcccaacagactggctgaacgcactcttcgggaacggcctatcacggtggatccttggagtcatcggcgtcctccttggcgggctcgccctcttcttcctcatactatccctattcaaactcggaacaaagcagatcttcaggtcacggacaaagctagcgtga

SEQ ID NO: 16527 - RNA, 3222 nt, synthetic construct
  misc_feature 1..3222: note = derived and/or modified CDS sequence (opt11) from SFTSV/FTLSV(2011YXX9)__KF711924.1__GP
  source 1..3222: mol_type = other RNA
atgatgaaagtgatctggttcagctcactggtgtgcctagtcattcagtgctccggagacagcggtccgatcatctgcgccggaccgatacacagcaacaaatcagcagcaatacctcacttgctaggctacagcgagaaaatctgccaaatagatcgacttatacacgtgagctcatggctccgcaaccactcacaattccagggctatgtcggacagcgcggaggcagaagccaggtcagctactaccccgccgaaaatagttatagcagatggtcaggactactatccccatgcgacgccgactggctaggtatgctagtggtgaagaaagccaaaggctccgacatgatcgtacccggccccagctacaagggcaaggtatttttcgaaagaccgactttcgacgggtacgtgggctggggatgcggctccggaaaaagcagaaccgaaagcggcgaactctgcagcagcgattcaggaacctccagtgggctactgccctcggatcgcgtgctctggatcggcgacgtcgcgtgccaacccatgactccaatcccggaagagaccttcctcgaactaaagagcttcagccaaagcgagttcccggacatatgcaaaatcgatggcatagtcttcaaccaatgggaaggcgaaagtctgccccaaccattcgacgtagcctggatggacgtcggacactcacacaaaatcataatgagggaacataaaacaaaatgggtacaggaatcgtcgtcgaaagacttcgtgtgctacaaagagggaaccggcccatgctcggagtctgaagagaaggcgtgtaaaacatcaggctcgtgcaggggtgacatgcaattctgcaaagtagccggatgcgaacacggggaggaggcttcagaagcaaaatgccgctgcagtctcgtacataagccgggcgaagttgtagtatcttatggaggaatgcgcgtacgaccaaagtgctacggcttcagcaggatgatggcaacaatggaagttaatccccctgaacaaagaatcgggcaatgcaccggatgtcatctcgagtgcataaacggcggcgtccggctaatcaccctcaccagcgaactgaaaagcgcaactgtgtgcgcaagccacttctgttcctcagcaacctccggcaagaaaagcaccgaaatacactttcactcagggtccctagtcggaaagacagcaatacacgtcaaaggagcactcgtggacggaaccgagttcacattcgaagggtcttgcatgttcccagacgggtgcaacgctgtagactgcacgttctgcagagagttcctcaaaaaccctcagtgctacccagcgaagaaatggctattcatcataatagtcatcttactcggatacgccggccttatgctactcaccaacgtcctgaaggcgatcggagtatggggaagctgggttatagccccagtcaaactcatgttcgcaatcatgaaaaagctgatgaggacagtaagctgccttgtcggaaaactgatggatcgggggcggcaagtaatacacgaagaaataggcgaaaacggagaagggaaccacgatgacgtccgaattgaaatggcgcgcccacggcgtgtcaggcattggatgtatagcccagtcatactgacaatactggccatcggactcgccgaaggttgcgacgaaatggtccatgcagactcgaaactcgtctcatgcagacagggaagcggtaacatgaaagaatgcgtaaccacaggaagggcactactacctagcgtgaaccccggccaagaagcgtgcctacactttacagcaccaggaagcccggacagcaaatgccttaaaatcaaagtcaagcgaatcaacctgaaatgtaaaaagagttcgtcctactttgtgccagacgctcgaaacagatgcacttccgtcagaaggtgccgatgggccggagactgccagtcaggatgtccgccccacttcaccagcaatagcttcagcgacgattgggccggcaaaatggacagggccggactagggttctcaggctgttccgacggctgcggcggggccgcctgcggctgctttaacgcagcccccagctgcatcttctggaggaaatgggtagaaaattcgcacgggattatatggaaagtcagtccatgcgccgcatgggtgccatctgcggttatagaactcacaatgccaagcggagaagtccgtacgttccacccaatgagcggcataccaacacaggtcttcaaaggagtaagcgtgacatacctaggtagcgacatggaggtctccgggctaaccgacttgtgcgaaattgaagaactaaaaagcaaaaagctagccctcgcgccgtgcaaccaagccggaatgggcgtcgtaggcaaggtaggcgagatccaatgctcatcggaagaatcggcacgcaccataaagaaagacggctgcatctggaacgcggacctcgttggcatcgaactccgagtagatgacgcagtttgctactcaaaaataacgtccgttgaagccgtagcgaactactcagcaatacccactacaataggagggctgaggttcgagcgaagccacgacagccaaggcaaaatctcaggaagcccgctcgacatcaccgcgatacgggggagcttctcagtaaactaccgggggctgcgtctgagcctaagcgaaataacagcaacctgcacaggagaagtaaccaacgtatctggttgctacagctgcatgacaggcgcgaaagtgtcgatcaagctgcacagcagcaaaaacagcaccgcacacgtccgatgcaaaggtgatgaaaccgcgttctcggtactagaaggggtacactcctataccgtcagcctgagctttgaccacgcagttgtagacgaacagtgccaactaaactgcggaggacacgaaagccaggtaacactaaaaggcaacctcattttcctcgacgtcccaaaattcgtagacggcagctatatgcaaacatatcatagcaccgtaccgacaggagccaacatccccagtcccaccgattggctcaacgcgctattcggcaacggcctatcacggtggatcctaggcgtgatcggggtattgcttggagggctggcactctttttcctgatcatgttcctgttcaagctagggaccaaacaagtattccggagccgaacgaagctcgcatga

SEQ ID NO: 16528 - RNA, 3222 nt, synthetic construct
  misc_feature 1..3222: note = derived and/or modified CDS sequence (opt11) from SFTSV/FTLSV(2012YGS10)__KF711937.1__GP
  source 1..3222: mol_type = other RNA
atgatgaaagtaatctggttctcatcgcttatatgcttcgtaatccaatgctccggcgattcaggcccgataatttgcgcaggcccaatacacagcaacaaaagcgccgacataccgcaccttctgggatacagcgagaaaatctgccagatagaccgactgatccacgtcagctcatggctcagaaatcacagccaattccaagggtacgtgggccagcgcggtggacggtcccaagtttcctactaccccgcagaaaactcatacagtcgatggtcaggactgctatccccctgcgacgcggactggctcggcatgctagtcgtcaaaaaggccaagggcagcgacatgatagtacccggcccgagctacaaaggaaaagtcttcttcgaacgtccgacattcgatggatacgtaggatggggatgcgggtcaggcaaatcaagaacagaatcaggagaactctgctccagcgacagcggaacctcgagcggactactaccctccgaccgggtactctggatcggagacgtagcctgccaacccatgacacccataccagaagaaacctttttggaactaaaaagtttcagccaaagcgagttcccggacatatgcaaaatcgacggaatagtattcaaccaatgcgaaggcgaatcacttccacagccattcgacgtcgcctggatggacgtaggtcactcgcacaaaatcatcatgcgcgaacataaaaccaagtgggtccaggaatcatccagcaaagacttcgtatgctacaaagaaggtacaggaccgtgcagtgaatcggaagaaaagacatgtaaaacatcaggatcgtgcagaggggatatgcaattctgcaaggtggccggatgcgagcacggagaagaagcgagcgaagcaaaatgccggtgcagcttggtccacaaacccggcgaagtcgtggtctcttacggtggcatgcgggtccggcccaagtgttacggattctcacgcatgatggcgaccctggaagtcaaccagccagaacagcggatcgggcaatgtaccggatgccaccttgagtgcatcaacggaggagtcagactcatcacgctcacaagcgaactaaagagcgctaccgtgtgcgcaagccacttctgctcatcagcaaccagcggcaaaaagagcaccgaaatacaattccactcaggatcgctcgtcggcaaaacagcaatccacgtaaagggcgcactcgtcgacggaaccgagttcacgttcgaagggtcatgcatgttcccagacggctgcgacgccgtagattgcacgttttgtcgggagttcctcaaaaacccacaatgctacccagcaaagaagtggctattcatcatcatagtaatcctcctaggctatgccggattgatgctactgaccaacgtactcaaagcaataggtatatggggcagttgggtgatagccccagtaaagctcatcttcgccatcattaagaaactcatgcgcacagtaagctgtttgatgggtaaactaatggaccgcgggcgtcaggtcatacacgaagaaataggagaaaacagagaaggcaatcaggacgacgtcagaattgagatggcacgcccccggcgcgtccgacactggatgtacagcccagtaatactcaccgtgctagcaatcggcctagccgaatcctgcgacgaaatggttcatgccgactccaaactcgtgagctgccgccaaggcagcggcaacatgaaagaatgcgtaacaaccgggagagccctactcccggccgtcaacccaggacaagaggcgtgcttacacttcaccgcgcctggatcaccagactcaaaatgtctaaaaataaaagtcaaacgaataaatctaaaatgcaagaaatcaagcagctacttcgtaccggacgcaaggagccgctgcacctccgtacgcagatgcagatgggccggcgactgccagtccggatgtcccccgcacttcacgtccaacagcttctccgatgattgggccggaaaaatggaccgagcaggcctaggattctcaggatgcagcgacggctgcgggggagcagcttgcggatgcttcaacgccgccccgagttgcatattctggagaaaatgggtcgaaaacccgcacggaataatttggaaagtaagcccatgcgctgcttgggtgccatccgccgtcatagaactaacaatgccaagcggggaagtccgcacattccaccccatgagcggaatacccacccaagtattcaaaggcgtaagcgtgacgtacctgggaagcgacatggaagttagcggactaaccgacttatgcgagatcgaagaactcaaaagcaagaaactcgcgctcgcaccctgtaaccaggcgggaatgggggtagtcggcaaagttggtgaaatacaatgcagttcggaggaatccgctcgaaccatcaagaaagacggttgcatatggaacgccgacctcgtaggtatcgaactgagagtcgacgacgccgtgtgctacagcaaaatcacatccgtagaagcagttgccaactacagcgccatcccgacgaccataggcggacttcgattcgaaagaagccacgattcacaaggcaaaatatccggcagccccctagacattaccgcgataagaggcagcttctcagtaaactacagaggtctacgcctcagcctctccgagatcacagccacatgcacaggcgaagtaaccaacgtatcgggctgctacagctgtatgactggcgcgaaagtcagcataaaactgcacagctcgaaaaactccaccgcccacgtgcgatgcaaaggcgacgagacggcgttctcagtgctagagggagtgcactcctatacggtgtccctgtcctttgaccacgccgtagtcgatgaacaatgccaactcaactgcgggggacatgaatcgcaagtcaccctaaaaggaaacctgatattcctcgacgtccccaaattcgtggacggctcgtacatgcaaacataccacagcacagtacccacaggcgcgaacataccaagtcctaccgactggctcaacgccctgtttggaaacggcctcagccgctggatcctgggagtcataggcgtcctcctaggtggattagcactcttcttcatgataatgtcactgttcaaactcggaacaaaacaggtcttccgctcccgcaccaaactagcgtga

SEQ ID NO: 16529 - RNA, 3222 nt, synthetic construct
  misc_feature 1..3222: note = derived and/or modified CDS sequence (opt11) from SFTSV/FTLSV(2012YGS4)__KF711933.1__GP
  source 1..3222: mol_type = other RNA
atgatgaaagtgatctggttcagcagcctcatatgcttcgtcatacaatgcagcggggattcgggcccaataatctgcgcaggaccaatacactccaataaaagcgcagacatcccgcatttactcggatactccgaaaagatctgtcaaatagaccgcctcatacacgtaagctcctggttaagaaaccactcgcaatttcaaggatacgtcggccagcgaggagggcgaagccaggtcagttactacccagccgagaacagctactcaaggtggagcggcttactaagcccctgtgacgccgactggctcggtatgctggtggtcaagaaggcgaaaggcagcgacatgatagtacccggccccagctacaaaggaaaagtgtttttcgaacgcccaacattcgacggctacgtaggatggggatgcggctcaggcaagagcaggaccgaaagtggagaactgtgctcatcagacagcggcaccagctcaggtctcctaccctcggacagggtcctctggatcggcgacgtcgcgtgccagcccatgacgccgatcccagaggagacattcctggaactaaaatcattcagccagtcagagttccccgacatatgcaaaatcgatggcatcgtgtttaaccagtgcgaaggagaatcactaccacaaccattcgacgtagcgtggatggacgtaggccactcgcacaaaatcataatgcgcgaacacaaaaccaaatgggtccaggaaagtagcagcaaagactttgtatgctacaaggaagggacaggcccctgcagtgaaagcgaagagaagacatgtaaaacgtccggatcatgcaggggcgatatgcaattttgtaaagtggcaggatgcgaacacggagaggaggccagcgaagccaaatgtaggtgtagcctagtacataagccaggcgaagtagtggtcagctacggaggaatgcgcgtgcgacccaagtgttacggattctcccgaatgatggccacgttggaagtcaaccagccagaacagcgaataggacaatgcaccggatgccacctcgaatgcataaacggcggcgtacggctaataaccctgacgagcgaactaaagtcggccactgtatgcgccagtcacttctgctccagcgcaacgtccgggaagaaaagcacagaaatacaattccatagcggcagcctagtaggaaaaaccgcaatacacgtaaaaggagcgctcgtagacggaacggaatttacctttgagggaagctgcatgttcccagacgggtgcgacgcagtagactgcaccttctgtagagagttccttaaaaacccccagtgctaccccgccaagaaatggctgttcatcataatcgttatcctactaggctacgcggggctaatgctcctgacaaacgtactaaaggccataggaatatggggaagctgggtcatagcgccggtaaagctaattttcgcaattataaagaaacttatgcgtacagtgtcgtgcttgatgggaaaactgatggacaggggacggcaggtaatacacgaagaaatcggcgaaaaccgtgaaggcaaccaggatgacgtcagaatcgagatggcccggccaagaagagtgcgccactggatgtacagccccgtcatcctcaccattctagcaataggactagcagaaagctgcgacgaaatggtccacgcagacagcaaattagtatcgtgccgccagggatccgggaacatgaaagagtgcgtaacgacagggagagctctactcccagccgtgaaccccggacaagaagcgtgtctgcacttcacagcgccaggcagcccagacagcaagtgcctaaaaataaaagtgaaacgtataaacctcaaatgcaagaaatcatcctcatacttcgtcccagacgcaagaagtcgttgcaccagcgtccgacgatgccgatgggccggggactgccaaagcggatgtcccccgcattttacgagcaatagtttcagcgacgactgggccggaaaaatggaccgagcaggactcggattctctggatgctcagacgggtgcggcggggcagcatgcggatgctttaacgccgccccttcctgcatattctggcgcaaatgggtggaaaacccccacggcatcatatggaaagtgtcgccgtgcgcagcatgggtaccatcggccgtaatagaactgaccatgccatcaggcgaggtacgcaccttccaccccatgagtggaataccgacacaggtatttaaaggcgtcagtgtgacctacctcggttccgacatggaggtgagcggactcacagacctctgcgaaatagaagaactcaaatccaagaaactcgcattagcaccctgcaaccaagcaggaatgggcgtagtcggcaaagtcggagaaatccaatgcagctctgaagagagcgctcgaacgatcaagaaagacggctgcatatggaacgcggacctcgtcggcatcgagctgcgagtagacgacgcagtgtgctactcaaaaataacatccgtcgaggcagtagcaaactacagcgcaatccctaccacaatcggcggactcaggttcgagcgcagccacgacagccaaggaaaaatatccggcattccacttgatatcaccgcgatcagaggatcgttctccgtaaactatcgaggcttgcgcctgagcctatccgaaataacagcaacatgcacaggcgaggtaaccaacgtaagtggctgctacagctgcatgacaggtgcgaaagtaagcatcaagctgcactcaagcaaaaacagtacagcccacgtacgctgtaaaggcgacgagacagcgttctcggtactcgaaggggtgcatagctacaccgtgtccctgagcttcgaccacgccgtggtggacgaacagtgccaactaaattgcggaggccacgaatcccaagtcacactaaaaggtaacctaatattcctcgacgttccgaaattcgtcgatggatcctacatgcaaacataccatagcaccgtaccgaccggggcgaacatcccaagccccacggactggctgaacgcactgttcggaaacggcttgtcaaggtggatcctgggcgtcattggagtcctcctgggcggcctagcactgttcttcatgatcatgagcctcttcaaactaggaacaaaacaggttttccgcagcaggacaaaactggcgtaa

SEQ ID NO: 16530 - RNA, 3222 nt, synthetic construct
  misc_feature 1..3222: note = derived and/or modified CDS sequence (opt11) from SFTSV/FTLSV(2012YSC6)__KF711931.1__GP
  source 1..3222: mol_type = other RNA
atgatgaaagtaatctggttctcctcgctcatatgcttcgtcatacaatgttccgggggctcgggccccataatctgcgcgggccccatccacagtaacaaaagtgcggacatcccccatctgctaggatactccgagaaaatatgccagatagacaggctcatacacgtaagctcgtggttacgcaaccacagtcaatttcaaggatacgtcggccaacgcggaggcagaagtcaggtcagttactacccagccgaaaactcatacagccgatggtcaggcctactatcaccatgcgacgcagactggctcggaatgctggtagtgaaaaaggcaaagggatcagacatgatcgtcccaggaccctcctacaaagggaaggtcttcttcgaacgacccacattcgatggatacgtgggatgggggtgcggctcaggaaaaagtcggacagagtccggcgaactatgctcatcggacagcgggacctcgagcggactccttccctcggaccgcgtcctctggatcggcgacgtcgcgtgccagcccatgacgccgatcccagaggagacattcctagaactcaagtccttcagtcaaagtgagtttccagacatatgcaaaatagacggcatagtcttcaaccaatgcgagggagagagcctaccccagcctatagacgttgcctggatggatgtcgggcactcacataaaataataatgcgcgagcacaaaacgaaatgggtccaagaatcgagcagcaaagacttcgtgtgctacaaagaaggaacaggcccatgctcagaaagtgaggagaaaacgtgcaaaacaagcggttcgtgcaggggagacatgcaattctgcaaagtggcaggatgcgaacacggggaagaagcctcagaagccaagtgccgatgcagcctggtgcacaaacccggggaagtagtggtaagctatgggggcatgcgagtacgaccaaaatgctacggattcagtagaatgatggcaaccctcgaagtgaaccagcccgaacaacgaataggacagtgtacagggtgccacttagaatgcattaacggaggcgtaaggttgataacgctgaccagcgaattaaagtcagcaaccgtatgcgcaagccatttctgcagctcagccacgtccgggaaaaagagcacagaaatacaattccattctggcagcctagtcggaaagacggccatccacgtgaaaggcgcactcgtagatggcactgagttcacgttcgaaggctcatgcatgttcccggacgggtgcgacgctgtggactgtacattctgcagagagttcctcaagaacccgcagtgctatccagccaagaaatggttgttcataattatagtgatcctcctaggttacgccggactcatgttgctcacgaatgtattaaaagcaatcggcatatgggggagctgggtcatagcccccgtcaaactaatattcgctataatcaagaaactcatgaggacggtatcatgtttaatgggaaaactcatggacagggggcgccaagttatccacgaagaaatcggcgaaaaccgagaaggaaaccaggacgatgtcagaatagaaatggcacgcccacgaagagtacgccactggatgtacagtccggtcatacttacaatcctcgccatcggactagccgaaagctgcgacgagatggtccacgcggactccaagctagtatcgtgtcgacagggtagcgggaacatgaaagaatgcgttacaacagggagggctctgctacccgccgtgaacccaggccaagaagcgtgcctccattttaccgcgccaggcagtcccgactccaaatgcctaaaaatcaaagtcaaacgcataaacctgaaatgcaagaaatcctcatcatactttgtgccggacgccaggagtcggtgcacgagcgtacgcagatgtaggtgggcaggcgattgccagtccggttgcccaccacacttcacatctaatagcttcagcgacgactgggccggcaaaatggacagagccggactcggattctcgggctgctcagatggctgtggaggagccgcctgcgggtgctttaacgcggccccaagctgcatcttctggcgaaaatgggttgagaacccacacggcataatctggaaagtctcgccctgcgccgcgtgggtcccctcagcagtaatcgaattaacaatgcccagtggagaagtacgcacattccacccaatgagcggcataccaactcaggtcttcaaaggagtcagtgttacatacttaggcagcgacatggaagtgagcgggctcacagacctctgcgagatcgaggaactcaaatccaaaaagctggcactggcaccttgtaaccaggccggaatgggggtcgtcggcaaggtcggcgaaatacaatgcagctctgaagagagcgcccgtacgatcaagaaagatggatgtatctggaatgcggacttagtgggaatcgaactccgggtagacgacgcggtatgctactcgaaaataacctcagtcgaagcagtagccaattacagcgcaattccaacgaccataggcggcctcaggttcgaacgatcgcacgacagccaaggcaagatctcgggtagccccctagacattaccgcgatcaggggctcgttcagcgtcaactaccgcggcctgcgcctgagcctctccgagataacggcgacgtgcacgggggaagtcactaacgtcagcgggtgctacagctgcatgacaggcgcaaaagtatccataaaactacatagcagcaagaacagcaccgcacatgtacgatgtaaaggcgatgaaacagccttcagtgtactagagggggtccatagctacaccgtcagcttgagcttcgaccacgcagtagtcgacgaacagtgccagctaaactgcggcggccatgagtcacaggtaacgctgaaaggaaacctgatcttcctcgacgtaccaaagtttgtagatggatcgtacatgcaaacgtaccattcaaccgtcccaaccggagccaacatccccagcccgacagactggctcaacgcgctgttcggaaacgggctgagtaggtggatcctaggggtcataggcgtgcttctcggaggactcgcactgtttttcatgatcatgagcctcttcaaactaggcaccaaacaagtattcaggagccgaaccaagctggcataa

SEQ ID NO: 16531 - RNA, 3222 nt, synthetic construct
  misc_feature 1..3222: note = derived and/or modified CDS sequence (opt11) from SFTSV/FTLSV(2012YSH10)__KF711940.1__GP
  source 1..3222: mol_type = other RNA
atgatgaaggtaatatggttcagcagcttaatctgcttcgtcatccaatgcagcggggacagcggcccaatcatatgcgccggtccgatccactccaacaagagcgccgacatcccccacctcctcggatacagcgaaaagatatgccaaatcgatcgactcattcatgtttcgtcctggctccgcaaccactcccaattccagggctacgtagggcaacgaggaggaagaagccaagtttcatactaccccgcagaaaactcctactcccgctggagcggactgctatccccctgcgacgcagactggctcggaatgttagtagttaagaaagcaaaaggctcagacatgatagtacccggaccatcatacaagggcaaagtgttctttgaaagaccgacatttgacgggtacgttggctggggctgcggctcaggaaaaagcagaaccgaaagtggcgaactgtgttcttcagatagcgggaccagcagcggactccttccatcaaaccgagtcctatggataggagatgtagcctgtcaacccatgacaccaattccggaagaaacattcctcgagcttaagagcttctcacaaagtgagttcccagacatctgcaaaattgacggcatcgtcttcaaccaatgcgaaggtgaaagtttgcctcagcccttcgacgtagcatggatggacgtaggacactcacataaaattattatgcgggaacacaaaacaaaatgggtacaagaatcatcctccaaggacttcgtatgctacaaagaaggcacaggcccatgctcagaatcggaagaaaagacctgcaaaacatcaggctcatgcagaggcgacatgcaattctgcaaagtggcaggctgcgaacacggggaagaagccagcgaagcgaaatgccgatgctcacttgtccacaaacccggagaagtcgtagtatcatacggcggcatgcgcgtccgccccaaatgctacgggttttcacgtatgatggcaacgctcgaagtaaaccaaccagaacaaagaataggacaatgcacaggctgccacctagaatgtattaacggcggagtacgcctgattaccctaacaagtgaactaaaaagcgcaaccgtatgcgccagtcacttttgcagcagcgccatgtccgggaagaaaagcacagaaatacaattccattcaggatccctcgtcgggaaaaccgcaatccacgtaaaaggagcgctcgtagacggaacagagttcacgttcgaaggctcgtgcatgttccccgatggctgcgatgcagtagactgcaccttctgcagagaatttctcaaaaacccacaatgctacccagcaaagaaatggttgttcatcatcatcgtcattctcctaggctacgccgggctgatgctgctcacaaacgtactgaaagcgataggcatatgggggagctgggtaatcgccccagtcaaacttatcttcgcgatcataaagaaactcatgcgtaccgtctcatgtctaatgggaaaactaatggaccgcggccgacaagtgatacacgaagaaataggcgaaaaccgagaagggaaccaagatgacgtccggatagaaatggcccgcccgcgtagagtaaggcactggatgtacagccccgttatattgacaattctggccatcggactggccgagagctgcgacgagatggtccacgcagactccaaactggtatcatgtcggcaaggaagtgggaacatgaaagaatgcgtcaccacaggcagagccctactgccagccgtcaacccgggacaggaagcatgcctacatttcacggcaccggggtccccagactcgaaatgcctcaggataaaagtaaaacgcatcaacttgaaatgcaagaaatcctcatcttacttcgtccctgacgccagatcgaggtgcaccagcgtccggcgatgccgctgggccggagactgccagagcggatgcccaccccactttacaagtaactccttctccgatgactgggcaggaaaaatggacagggccggactcggcttctcaggttgcagcgacggctgcggcggggccgcgtgcggatgcttcaacgccgcacccagttgcatcttctggcggaaatgggtcgaaaacccccacgggataatctggaaagtcagcccatgtgccgcgtgggtacccagtgccgtgatcgaattaacaatgccatccggggaagtacgcacattccaccccatgagcggcatcccgacccaagtcttcaaaggtgtctcagtaacatacctgggttctgatatggaagtctccgggctcaccgatctttgcgaaatcgaagaactgaaaagcaagaaactggctctcgcaccatgcaatcaggccgggatgggggtcgtcggaaaagtcggggagatacaatgttcctcagaggaatccgcgaggacaataaagaaagatggctgcatttggaacgcagacctggtcggcatagaactccgcgtcgacgacgcagtctgctactcaaaaatcacgtcagtcgaagccgtagccaactactcggccatccccactacaatcggaggactcagatttgaacgtagccacgacagccaaggaaaaatctcaggatcacccctggacatcactgcgatccgcggatcattctcggtcaattaccgcggattacgtctaagcctctccgaaataaccgcaacctgcacaggagaggtaacaaacgtctccggctgctacagctgcatgaccggcgccaaggtcagcataaaattacactcctccaaaaacagcacagctcacgtgcgctgtaagggggacgaaaccgcgttctcggtcctcgaaggagtccactcgtacactgtaagtctttccttcgaccacgccgtagtggatgaacagtgccagcttaactgcggaggtcacgagagccaagtcaccctaaaaggaaacctaatctttctcgacgtccccaaattcgttgacggctcatacatgcaaacctaccactccacagtacccaccggcgcgaacatccctagccccaccgactggctcaacgcactcttcggtaacggcctaagccggtgggtgctcggggtgatgggagtactcctgggaggactcgccttattcttcatgatcatgtcactattcaaactgggaacaaagcaagtgttccgatcacgaaccaagctcgcatga

SEQ ID NO: 16532 - RNA, 3222 nt, synthetic construct
  misc_feature 1..3222: note = derived and/or modified CDS sequence (opt11) from SFTSV/FTLSV(2012YSH104)__KF711943.1__GP
  source 1..3222: mol_type = other RNA
atgatgaaagtaatatggttctcctcgctaatctgctttgtaatccagtgctccggagactcaggcccaataatatgcgcaggcccgatccacagcaacaagagcgcagacatcccacatttgctaggatactccgagaaaatttgccaaatcgatcggctcatacacgtaagctcatggcttagaaaccattctcaattccaaggatacgtagggcaaagagggggaagatcacaggtatcctactacccagcagaaaactcttactcaaggtggagcgggctactcagcccctgcgacgcagactggctcggaatgctggtcgtgaaaaaggcaaaggggtcggacatgatagtacccggcccgagctacaaaggcaaggtattcttcgaaaggccgaccttcgacggctacgtagggtggggctgcggcagcggcaagagcagaacggaaagcggagagctctgctcaagcgactccgggacaagcagcgggctcctacctagcaacagggtcctatggataggagacgtcgcatgccagccaatgacaccaatcccagaagaaaccttcctcgaactaaaatcattctcacagtcagagttcccggacatctgcaaaatagatggaatcgtattcaaccaatgcgaaggtgaatctctaccacagccattcgacgtagcctggatggacgtcggacatagccacaaaatcataatgagggaacacaaaacgaagtgggtccaagagtcgtcctcgaaagatttcgtctgctacaaagaaggcaccggcccctgctccgaaagcgaagaaaagacatgcaaaacaagcggctcatgccgcggcgacatgcaattctgcaaagtagccggctgcgaacacggcgaagaagcaagtgaggcgaaatgccgatgcagcctcgtccacaaacctggcgaagtagtcgtcagttacgggggtatgcgcgtacgaccaaaatgctacggattctcccgaatgatggcgaccctcgaagtgaaccagccggaacaacgcataggccaatgcaccggctgccacctcgaatgcatcaacgggggagtccgactgatcacgttaaccagcgagctcaagtccgcaacagtatgcgcctcccacttctgcagcagcgcaacaagcggcaagaaaagcacagaaatacagttccactcgggttcgctagtaggaaaaaccgctatccacgtcaaaggagcattagtagacggaactgaatttacgttcgagggctcatgcatgttcccagacggatgcgacgccgtagactgcacattttgcaggaaatttctcaagaacccacaatgctatccagcaaagaaatggctattcataatcatcgtaatactcctaggatacgcgggactcatgctactaaccaacgtgctcaaagccatcggcatctggggatcctgggtaatagccccagtaaaactgatatttgccatcataaagaaactcacaagaaccgtcagctgtctgatgggcaaacttatggatagaggaagacaggtgatacacgaagagataggcgaaaacagggaaggaaatcaagatgacgtcagaattgaaatggcacgcccccggcgagtcaggcactggatgtacagccccgtcatcctcacaattctcgcaataggactggctgagagctgcgacgaaatggtgcacgcagacagcaaactcgtctcctgccggcaagggagcgggaacatgaaagaatgcgtcaccacgggacgcgccctgctcccagcagttaacccgggccaagaagcctgcctacactttaccgcaccagggagccccgactcaaaatgtctgagaatcaaagtcaaaagaataaacctaaaatgtaaaaagtcaagctcatacttcgtccccgacgcacgataccgatgcacaagcgtccgccgctgccgatgggcaggcgactgccagtcaggatgcccgccccactttacaagcaacagcttctccgatgactgggccggaaaaatggaccgcgcaggactaggattcagcggctgcagcgacggatgcgggggagcagcgtgcgggtgcttcaacgccgcaccctcgtgtatattctggcgaaaatgggtagaaaacccccacggcataatatggaaggtaagcccatgcgcagcatgggtaccaagcgcagtaatagaactcacaatgccgagcggagaggtgcgcacattccacccaatgtccgggatccccacacaagtcttcaaaggggtctccgttacgtatctcggcagcgacatggaagtcagcggcctcacggatctatgtgagatagaggaactgaaaagtaaaaagctagcactggcaccatgcaaccaggcggggatgggagtcgtaggcaaagtgggagaaatacaatgctcaagtgaagaaagcgcccgcacaatcaaaaaggacggctgcatatggaacgccgacctggtcggaatcgaactaagagtagacgacgcagtatgctacagcaaaataacaagcgtcgaagccgtcgcaaactacagcgccatacccacgacgatcggcggacttcggttcgaacgctcccacgacagccaaggcaaaatatcgggttcgccactcgacataacggcaatccgaggatcattctcggtaaactatagaggactccgcctcagcctaagcgagatcacagccacttgtacaggcgaagtaacgaacgtctccggctgttacagttgcatgaccggggccaaagtcagtataaagctccacagctcaaagaacagcaccgcgcacgtccggtgcaagggagatgaaacagcattctcagtcctagaaggagtccatagctacacagtcagcctctccttcgaccacgccgtcgtagacgaacaatgccagctaaactgcggaggccacgaatcacaagtaaccctgaaaggaaacctaatatttctcgacgtaccgaaattcgtggatgggtcatacatgcaaacataccatagcaccgtaccaacaggagccaacatccccagccccaccgactggctcaacgcactgtttggaaacgggctgtcgaggtgggtactaggcgtgatgggggtgctgctcggagggctcgcactattctttatgataatgagcctattcaagctagggacaaaacaagtattcagaagtagaacaaaactagcgtaa

SEQ ID NO: 16533 - RNA, 3222 nt, synthetic construct
  misc_feature 1..3222: note = derived and/or modified CDS sequence (opt11) from SFTSV/FTLSV(2012YSH105)__KF711944.1__GP
  source 1..3222: mol_type = other RNA
atgatgaaagtcatatggtttagctccctcatatgcttcgtaatccaatgcagcggagacagcggacctatcatatgcgcgggcccaatacactccaacaaatctgcagacatcccacacctcctagggtacagtgagaaaatctgccaaattgaccgactcatacacgtaagctcctggctacgaaaccacagccaattccaaggctacgtcggacagagaggcggcaggtcacaagtctcatactatcccgccgagaacagctactcaagatggtccggattactatccccatgcgacgccgactggctcgggatgctagtagtcaaaaaggcaaaaggcagcgacatgatagtacccggcccctcctacaaggggaaagtattcttcgaacgcccaaccttcgacggatacgtaggatggggctgcggctccggtaagagccgaactgagagcggcgaactctgctcctccgattccgggacaagcagcggcctcctgccctcaaaccgcgtgctatggataggcgacgtagcatgccagcctatgaccccgataccagaagaaacgttcctcgagctcaagagtttcagccaaagcgagttccccgacatctgtaagatcgatgggatagtcttcaaccaatgcgaaggcgaaagcctcccccaaccattcgacgtagcctggatggacgtcgggcacagtcacaagataataatgagagaacacaaaacaaaatgggtgcaagaatcgagttccaaggactttgtctgctacaaagaaggaacagggccgtgcagcgaatcagaagagaaaacatgcaagacctccggatcgtgcaggggcgatatgcagttctgcaaggtggccgggtgcgaacacggagaggaagcatcggaagccaaatgccgctgcagtctagtccacaagcccggcgaggttgtcgtatcctacggagggatgcgcgtacgaccgaaatgctacggcttctcacgaatgatggcaaccctagaagtcaaccaaccggagcaaagaatcggacaatgtactggatgccacctcgagtgcatcaatggcggagttcgactcatcaccctgaccagcgaactcaagtccgcaacagtatgtgcgagccacttctgctcatccgcgacaagcgggaagaaatccacggagatacaatttcactcgggatcccttgtcggaaaaaccgcaatccacgtaaaaggcgctctcgtggacgggaccgagttcacattcgaagggagctgcatgtttcctgacggctgcgacgccgtcgactgtacattctgccgcgagttcctaaagaaccctcaatgctaccctgccaagaaatggctattcatcattatagttatactcctcggctatgccggccttatgctactaaccaacgttctcaaggcgatcggcatatggggcagctgggttatcgccccagtcaaactcatcttcgcaatcataaagaaactgatgcgcacagtgagttgcctcatgggtaaactaatggaccggggacgccaagtaatccatgaagaaataggtgaaaaccgcgaaggaaaccaggacgacgtccgcatagaaatggcgcgaccacgccgggtacgacactggatgtactccccagtaattctaaccatattggcaataggcctcgccgaaagctgcgatgaaatggtacacgcggactcaaaactcgtatcgtgccgacaaggaagcggaaacatgaaagagtgcgtaactacagggagagccctactccccgccgtcaacccgggtcaagaagcgtgcctccacttcacggccccggggagcccggactcaaaatgccttcgtatcaaagtcaaaagaatcaacctaaaatgcaaaaagagcagctcctacttcgtgccggacgcccgcagtcgatgcacaagcgtgcggagatgccggtgggccggcgactgccaaagcggatgcccgccccacttcacttcaaacagtttcagcggcgactgggcggggaaaatggacagagccggcctcgggtttagcggttgctcagacggatgcggcggggcagcctgcggctgtttcaacgcagccccaagctgtatcttctggagaaaatgggtcgaaaacccacacgggatcatatggaaggtcagcccatgcgcggcctgggtcccgtcagcagtcatcgaactaacaatgccgagcggagaagtacgaacattccacccaatgtcaggaatcccaacccaagtcttcaaaggcgtgagcgtaacgtacctgggttcagacatggaagtcagcggcctgaccgatctatgcgagatagaagaactaaaatctaagaaactagcactagcaccatgtaaccaagctgggatgggggtcgtaggaaaagtcggagaaatacaatgcagctcagaagagagcgcacgcaccatcaagaaagacggctgtatctggaacgcagacctggtgggcatcgagctaagggtcgatgacgcggtctgctactccaaaataacatcagtcgaagcagtcgctaattacagtgcaatccccacaaccataggcgggctcagattcgaaagatcccacgactcacaaggcaaaatatccggatcacccctagacataacagcgataagaggttcattcagcgtcaactaccgcgggctaagactgtcactaagcgaaatcacagcaacctgcacgggcgaagtcactaacgtaagtggctgctacagctgcatgacgggcgcaaaagtaagcataaaattacacagctccaaaaactcaacggcgcacgtacgatgcaaaggcgacgagactgcattctccgtcctggaaggcgtgcattcgtacaccgtaagcctgtcctttgaccacgcagtagtcgacgaacaatgccagctaaactgcggaggacacgaatcgcaagtgactctcaaggggaacctaatcttcctagatgtaccaaagttcgtagacggctcatacatgcagacctaccacagtaccgtcccaacaggagccaacatcccgagcccgacggactggttaaacgccctcttcgggaacggtctaagccgatggattctgggagtcatgggagtgcttctgggcgggctagcgctatttttcatgataatgtcactattcaaattaggcacgaagcaagttttcaggtctcgcaccaaactagcctga

SEQ ID NO: 16534 - RNA, 3222 nt, synthetic construct
  misc_feature 1..3222: note = derived and/or modified CDS sequence (opt11) from SFTSV/FTLSV(2012YSH107)__KF711942.1__GP
  source 1..3222: mol_type = other RNA
atgatgaaggtcatatggttcagctccctcatatgcttcgtaattcaatgcagcggagactccggtcccataatttgcgcagggccaatacacagcaataaaagcgccgacataccgcacctcctaggatacagcgagaaaatctgccaaatagaccggctcatacacgtatcgagctggctacgcaaccacagtcaattccaaggatacgtcggccaaagagggggccggtcgcaagtatcctactatcccgccgaaaattcctactcccggtggtcaggcctactaagcccatgcgacgcggactggctcgggatgctcgtcgtaaagaaggcaaaaggctcagatatgatagtacccgggccctcgtataagggcaaagtgttcttcgaacgaccaactttcgatggatacgtgggctgggggtgtggatccggcaaaagcagaacagaaagcggcgaactctgcagctcggacagcggaacgtccagcgggctactcccctcgaaccgagtactatggataggagatgtagcatgccaaccaatgaccccgataccagaggaaaccttcctggaactcaagtcctttagccaaagcgagttccccgatatctgcaaaatcgacggaatagtgttcaaccaatgcgaaggcgaaagcctaccacaaccgttcgatgtagcatggatggacgtgggacacagccacaaaatcatcatgagagaacacaaaaccaaatgggtccaggaaagtagctccaaagacttcgtatgctataaagaaggcacaggaccatgctcggaatccgaagagaaaacagggaagacctcaggctcatgccgtggtgatatgcaattctgcaaagttgcaggttgcgaacacggcgaagaagcatcagaagcgaaatgtcgctgcagcctagtccataaacccggggaagtagtggtatcgtacggagggatgcgcgtccggcccaaatgctacggattctcccgaatgatggcaaccttagaagtaaaccagcctgaacaaaggataggacaatgcaccggttgccatctcgagtgcatcaacggcggcgtacgcctaatcacactaacgtctgaactaaaaagcgccacagtctgcgcaagccatttctgctccagcgccaccagcggcaagaaaagcacagagatacaattccactcaggatccctcgttggcaaaacagcgatacacgtcaaaggggcactcgtcgacggaaccgaatttacgtttgaaggctcctgcatgtttcctgacggctgtgacgccgtagactgtaccttctgccgcgagttcctaaagaacccccaatgctacccggccaagaaatggctgttcatcattatcgtaatactccttgggtacgcaggcctgatgctcctcacaaacgtactaaaggccataggcatttggggaagctgggtgatcgccccagtcaagctcatattcgcaataataaagaaacttatgcgaacggtctcctgtctaatgggaaaactaatggaccgcggccggcaagtgatacacgaagaaataggggaaaaccgagaaggaaaccaagacgacgtccgaattgaaatggcaagaccgcggagagtccgtcactggatgtactctccagtcatactaaccatcctcgccataggcctggcagaatcctgcgacgaaatggtgcatgccgactccaaactcgtatcttgcaggcaaggaagcggtaacatgaaagaatgcgtaacaaccggtagagccctgctacccgccgtaaaccccggtcaggaagcgtgcctccacttcacagctccgggcagcccagactcgaaatgcctccgcatcaaagtgaaaaggatcaacctcaaatgcaagaaaagctcgagctacttcgttcccgacgccagataccgatgcacctcagtgcgccgctgccgctgggcgggcgactgccaaagcggctgtccaccgcacttcacgtcaaactccttcagtgacgactgggcgggaaagatggaccgggcaggactgggattctcgggatgctccgacgggtgcggcggggcagcctgcggttgcttcaacgcagccccgagctgcatattctggcgcaaatgggtagaaaatccgcacggcataatatggaaggtcagcccctgcgcagcatgggtgcccagcgcagtcatcgagctaaccatgccgtcaggagaggtgcgcacattccaccccatgtcaggaatccccacccaagtcttcaaaggggtgtcagtgacatacttaggaagtgacatggaagtgagcggcctcacggacctctgcgagatcgaagaactaaagtcgaagaaacttgcccttgctccatgcaaccaggccggcatgggagtagtgggaaaagttggagagatccaatgtagctcagaagagagcgcgagaacaatcaagaaagacggctgcatatggaacgcagacctagtaggaatagaactcagagtagacgacgccgtctgctactccaaaataacttcggtggaggccgtcgcaaactactcggcaatccccacaaccattggcggactaagattcgagaggagccacgacagccaaggcaaaatatcagggtcaccgctcgacataaccgcgataaggggcagcttcagcgtgaactacagaggactccgactaagcctcagcgagataacggcaacatgcacaggcgaggtaacaaacgtctcaggctgctacagctgcatgaccggagcaaaagtaagcataaaacttcattcatccaaaaattccacagcgcacgtccgttgtaagggagacgagacagcatttagcgtcctagaaggcgtacacagttacacagttagcttgtcattcgaccacgccgtagtcgacgagcaatgccaactcaattgtggcggacacgagtcccaagtaaccctaaagggaaacctcatcttcctcgatgtgccaaaattcgtcgacggctcgtacatgcaaacataccacagtaccgttccaacaggagccaacattccgagccccaccgactggctcaacgcactattcggcaacggccttagccgatgggtgctaggagtaatgggcgtcctcctaggcggcctcgccctcttcttcatgataatgagcctattcaaactaggcacaaaacaggtattccgatccagaacaaaactagcctaa

SEQ ID NO: 16535 - RNA, 3222 nt, synthetic construct
  misc_feature 1..3222: note = derived and/or modified CDS sequence (opt11) from SFTSV/FTLSV(2012YSH14)__KF711938.1__GP
  source 1..3222: mol_type = other RNA
atgatgaaagtaatctggtttagctcactcatttgcttcgtcatccaatgctccggggactcgggaccgataatttgcgccggaccaatacacagcaacaaatcagccgacatcccccacctactaggatatagtgaaaagatatgtcaaatcgaccggctgatccacgtaagtagctggctgcgcaaccacagtcagttccaaggctacgtaggtcaacgtgggggccggagccaagtgtcctactacccagcagagaacagctactcacgatggtcaggcctcctatcaccctgcgacgccgactggctagggatgctagtagtcaagaaagcaaaaggcagcgacatgatcgtaccaggaccttcgtataagggcaaagtcttcttcgagcgccccacattcgatggatacgtaggctggggctgcgggtcaggaaagagcagaactgagagcggggagctctgttcctccgatagcggaacgtcgtcaggactattaccatcggacagggtactatggatcggcgacgtagcatgccaacctatgacacccatacccgaagagacctttctagagctaaaatccttcagccaaagtgagttcccggacatttgcaaaatcgacggcatcgtctttaaccaatgcgaaggagaaagcctaccccagcctttcgacgtggcctggatggacgtggggcactcacacaagatcataatgagagaacacaagacaaaatgggtccaagaatcgagctcaaaggacttcgtgtgctacaaggaaggcactgggccgtgttcagaaagcgaagagaaaacctgcaaaacaagcggcagctgcagaggagacatgcaattctgcaaagtggccggatgcgagcacggagaagaagcctccgaagcaaaatgccggtgcagtctggtccacaaaccaggagaagtcgtggtctcatacggaggcatgcgggtcaggccaaaatgctacggtttctcgaggatgatggcgacgctggaagtgaaccaacctgaacagaggatcggacaatgcacaggatgccatcttgaatgcataatcggaggcgtacggctcataacactgacaagtgagctcaagagcgcgacagtatgcgcatcccacttctgcagctcggcaacgagtggtaagaagtccacggagatacagttccatagcggatctctcgtcgggaaaactgcgatccacgtcaagggcgccctcgtcgacggcacagagttcacattcgaaggatcgtgcatgttcccggacggctgcgacgcagtagactgcacattctgccgagagttcctcaagaacccccaatgctacccagccaagaaatggctgttcatcataatagttatcctactcggatacgcagggctcatgctactaacaaacgttctgaaagccataggcatatggggaagctgggttatcgccccggtaaaactcatattcgccatcataaagaaactaatgaggacggtctcatgcctcatggggaaactgatggatagaggacgccaagtcatccacgaagaaatcggggaaaaccgagaagggaatcaagatgatgtcagaatcgaaatggcccgcccacgccgggtcaggcactggatgtattccccagttatactgaccatcctagccatcgggctagcagaatcgtgcgatgaaatggtccacgctgactcaaaattggtcagctgccgacaagggagcgggaacatgaaagaatgcgtaacaaccggccgggctctactcccagccgtaaacccaggccaggaagcatgcctgcacttcactgcccctggttctccggacagcaaatgcttgaaaataaaagtcaaacggataaaccttaaatgcaagaaaagcagcagctacttcgtcccggacgccagaagccggtgcaccagcgtgcgtaggtgtaggtgggcgggcgactgccaaagcgggtgcccaccccacttcacgtcgaacagcttcagcgacgactgggcgggcaaaatggaccgggcaggactcggattctcgggttgcagtgacggatgcggcggggccgcatgtgggtgctttaacgcagcccctagctgcatattctggcggaaatgggtcgaaaacccgcacggtataatatggaaagtctcaccttgtgccgcatgggtacccagcgccgtgatcgagctaacaatgccgagcggcgaagtcaggacattccacccaatgagcggaatccccacacaggtcttcaaaggagtctccgtaacgtacctagggtccgatatggaagtatcggggctaaccgacctttgcgaaatagaagaactaaaaagtaagaaactagcactcgcgccatgcaaccaagcaggaatgggcgtcgtaggcaaagtcggagaaatccagtgttccagtgaagagagcgcgagaacaataaagaaggacggctgcatatggaacgcagacctagtaggaatcgagctaagggtcgacgacgccgtatgctactccaaaattacatcggtcgaagcagtggccaactactcagcaatccccacaaccataggcgggctcagatttgaaagatcacacgacagccagggcaaaatcagcggaagcccactggacataacggcaatacgaggctcattttcggtcaactacaggggattaagactaagcctaagcgaaatcacagccacatgcacaggcgaggtaacaaacgtaagcgggtgttactcatgcatgaccggagccaaagtaagcatcaaactacacagcagcaagaactctactgcacacgtaagatgtaaaggagacgagacagcgttcagcgtactcgaaggcgtccacagctataccgtgtccctcagcttcgaccatgcagtggttgacgaacaatgccaactaaactgcggcggacacgaatcacaggtcacgctgaaagggaacctaatattcctagacgtcccaaaattcgtcgacggctcatacatgcaaacctatcatagcacagtcccgaccggggccaacatcccgtcacccacagactggctcaacgcgctgttcggaaacggactgtctcgatggatactcggagtcatcggcgtactgctgggcgggctcgcactatttttcatgataatgagtcttttcaagctagggacaaagcaagtattcagaagccgaaccaagctcgcgtaa

SEQ ID NO: 16536 - RNA, 3222 nt, synthetic construct
  misc_feature 1..3222: note = derived and/or modified CDS sequence (opt11) from SFTSV/FTLSV(2012YSH16)__KF711934.1__GP
  source 1..3222: mol_type = other RNA
atgatgaaagtcatctggttcagctcgctcatctgcttcgtaatacaatgttccggagacagcggcccaatcatctgcgccggacccattcacagcaacaaatccgccgacatcccgcacctactagggtactcagagaaaatctgccaaatagacaggctcatacacgtaagctcatggctcagaaaccactcccaattccagggctatgtgggccagaggggaggacgctcacaagttagctactacccagccgaaaattcatactcacgctggagcggactactcagcccctgcgacgcagactggctaggtatgttagtagtaaagaaagcgaaaggaagcgacatgattgtcccaggccctagctataaaggaaaagtatttttcgaacgaccaaccttcgacggctacgtgggctggggctgcggatcaggcaaaagccgaaccgaaagcggcgaactctgctcatccgactccggcacatcgtcaggcctcttgccatcagatagggtactatggatcggagacgtagcctgccaaccaatgacgcccattcccgaagaaacctttctagaattaaaatccttctcccaatccgagttccccgacatctgcaaaatcgacggtatcgtatttaaccaatgcgaaggcgaaagcctccctcagccgttcgatgtcgcatggatggacgtcggccacagccacaaaatcatcatgcgagaacacaaaacaaaatgggtgcaggagtcctcatcgaaagacttcgtctgctataaagaaggaacgggaccctgcagtgaatcagaagagaaaacctgcaaaacgtcagggagctgccgcggcgacatgcagttctgcaaagtggcgggttgcgaacacggagaagaagcctcagaagccaaatgccggtgctccctggtccacaaaccgggagaagtcgtcgtcagctacggcgggatgcgcgtgcgccccaaatgttacggatttagccgtatgatggcgacactggaagtgaaccaacccgaacaacgcatcggacagtgtactggctgccacctcgaatgcatcaacgggggcgtccgactcatcaccctcacaagcgaactcaaatccgccacagtctgcgcaagtcacttctgctcatctgcaacgagtggcaagaaatccacagaaatacaattccactccgggagcctcgtcggcaaaacagccatccacgtcaaaggggcattggtagatggaactgagttcacattcgaaggatcttgcatgttcccagacggatgcgacgcagtcgactgcacgttctgccgagagttcctcaaaaacccccaatgctacccagcaaagaaatggctattcataataatcgttatactactcggctacgcaggcctcatgctgctcaccaacgtactcaaagcaatcggcatctggggctcctgggtcatcgcccccgtgaaactcatattcgccatcatcaagaaactcatgcgtacagtcagctgtctaatgggaaaactaatggaccgcggccgtcaagtcatccacgaagaaatcggagaaaaccgcgaaggaaaccaggacgacgtacggatagaaatggcaagacccagacgagtccggcattggatgtacagtcccgtcatcctaaccatcctagctataggcttagccgaaagctgcgacgaaatggttcacgcagacagcaaacttgtttcctgccgccaaggaagcggaaacatgaaagaatgcgtgacaaccggaagggccctactacctgcagtcaaccccgggcaagaagcctgcctacacttcacagcacccgggagtccagacagcaaatgcctgaaaataaaggtcaagcgaatcaacctcaaatgtaagaaatcgtcgtcctacttcgtaccggacgcacgataccgatgcacaagcgtccgccgctgccgatgggccggtgactgtcaaagcggatgtcccccacacttcacatccaacagcttctcagacgactgggcaggcaaaatggaccgcgcaggactcgggttctccggctgcagtgatggatgcgggggtgcagcatgcggatgcttcaacgccgcacccagctgcatcttctggcgcaaatgggtcgaaaaccctcacggcattatctggaaagtctccccatgcgcggcatgggtgcccagcgccgtaatcgaactcacaatgccctcgggcgaggtccgaacattccaccccatgagcggaatcccaacccaagtattcaaaggcgtctcagtaacctacttaggcagcgacatggaggttagcggactaaccgacctctgcgaaatcgaggaactaaagtccaagaaactcgcccttgcaccctgcaaccaggcgggcatgggggtggttggcaaagtgggagaaatacaatgctcaagcgaagaatcagcccgcacaatcaagaaagacggttgcatctggaacgcggacctagtaggaatcgagctccgcgtagacgacgcagtgtgctactctaaaatcaccagtgtcgaagccgtagcaaactactccgcaatccccaccacaataggcgggctacgattcgagcgatcacacgacagccaagggaagatctcaggatcaccgctcgacataaccgcaatcagaggatcattcagcgtaaactaccgaggcttacgactaagcctatcagagataacggcaacctgcaccggcgaggtaaccaacgtatccggatgctactcctgcatgactggggcgaaagtaagcatcaaactccactcctcgaagaactcgacggcgcacgtacgatgcaaaggagacgaaaccgcattctccgtcttagagggcgtccacagctacaccgtctccctctctttcgaccacgcagttgtagacgaacaatgccaactcaactgcggaggccatgaatcccaggtaacactaaaaggcaacctgatattcctcgacgtaccaaaattcgtcgacgggagctacatgcaaacctaccactcgaccgtaccaaccggagcaaacatccccagccccaccgactggctgaacgcacttttcggaaacggactcagtaggtggatactaggagtaatcggcgtcctcttaggagggctagccctcttctttatgataatgagcctattcaaactgggaacaaaacaggtctttagaagcagaaccaaactcgcctaa

SEQ ID NO: 16537 - RNA, 3222 nt, synthetic construct
  misc_feature 1..3222: note = derived and/or modified CDS sequence (opt11) from SFTSV/FTLSV(2012YSH6)__KF711921.1__GP
  source 1..3222: mol_type = other RNA
atgatgaaagtgatctggttcagctcgctaatctgcttggtcatacaatgtagcggagacagcggacccatcatctgcgccggaccaatccacagcaacaaatcagcaggcatcccccatctgctaggatactctgagaagatatgccaaatagaccgactcatacacgtctcaagctggctccgtaaccactcgcaattccaggggtacgtaggccagagaggaggccgcagccaggtatcctactaccccgccgaaaacagctactcaagatggaacggactactttcaccatgtgacgccgactggctaggaatgctggtcgtcaagaaagcaaaagaatcggatatgatagtgccaggacccagctacaaaggcaaggtatttttcgaacgccccactttcgacggctacgtcggctggggctgcggctcgggcaagagcagaacagaaagcggagaactgtgctcgagcgacagcggaacctcgtccggattacttccctcagatcgagtcctgtggataggcgacgtcgcgtgccagccaatgaccccaataccagaagagaccttcctcgaactcaagagcttcagccagagtgagttcccagacatctgcaaaatagacggaattgtgttcaaccagtgcgaaggggaatcactcccccagcccttcgacgtggcatggatggacgtcggacactcccacaaaataatcatgcgcgaacacaaaaccaaatgggtccaagagtcaagcagcaaagacttcgtctgctacaaagagggaacaggcccctgttccgaaagcgaagaaaaagcctgcaaaacatcaggctcctgccgcggagacatgcaattctgtaaagtagcaggctgcgaacacggcgaagaggcatcagaagcaaagtgtaggtgctcactggtacacaaacccggcgaggtcgtcgtctcttacggcggaatgcgcgtgcgccccaaatgctacggcttctcccgcatgatggcgaccctggaagtaaacccaccagagcagcgtatcggacaatgtacaggatgtcacctagaatgcattaacggcggagtaaggctcataacgctcacatctgaactgcgatcggcgacagtctgcgcctcacatttctgcagctccgccacgagtggaaagaaaagtacagaaatacacttccactcaggctcacttgtgggcaaaacagctatacacgtaaagggcgctctagtagatggcaccgagttcaccttcgaaggctcctgcatgttcccggacggatgcgacgcagtcgactgcaccttctgcagagagttcctcaaaaacccacagtgctacccagcaaagaaatggttattcatcatcattgtaatcctgttaggctacgcagggctaatgctcgtcaccaacgtacttaaagctattggagtgtggggttcctgggtcatagccccagtaaaactaatgttcgcgataataaagaaactcatgcgaaccgtatcatgcctagtcggcaaactaatggaccgcggacgccaagtcatccacgaagaaatcggcgaaaacggagaaggaaatcaggacgacgtccgcattgaaatggcaaggccccgccgcgtacgccattggatgtacagcccggtaatcctaacgatccttgccataggattagccgaaggctgcgatgagatggtacacgccgacagcaaactcgtgagctgccgccaagggtcaggcaacatgaaagaatgcataacaaccggacgagccctgctacctgcggtaaatcccggccaagaggcatgtctacacttcacagcgccggggtcgccagactctaaatgtctcaaaataaaagtgaagcggatcaacctcaagtgcaaaaagagttcatcctacttcgtacccgacgccaggtccaggtgcacaagcgtacgacgctgccgctgggcaggagactgccaaagcggatgccctccccacttcaccagtaactccttttcagatgactgggccggtaaaatggaccgtgccggcctcggattcagtggttgctcagacggctgcggaggagcagcgtgcggttgtttcaatgccgcgcccagctgcatcttttggaggaaatgggtcgagaacccgcacggaatcatatggaaggtcagcccatgcgcagcctgggtcccgtccgccgtcatagagctcaccatgcccagtggagaagtacgcacattccaccccatgtccggcataccaacccaagtattcaaaggagtgtcagtaacgtacctcggctccgacatggaagtatccggtctcacagacctatgcgaaatagaagaactcaaaagtaaaaagctagcactagccccatgcaaccaagccgggatgggagtcgtcggcaaagtaggagaaatccaatgctcctccgaagaaagcgcaagaacaataaagaaagacggatgcatatggaacgcggacctagtaggtatagaactacgtgtggacgacgcagtctgctactcaaaaatcacttccgtcgaagccgtcgccaactactccgcgatcccaaccactatcggtggcctacgcttcgaacgcagccacgactcgcaaggcaaaatctcaggaagcccactcgacataaccgcaatccgcggatccttctcagtaaactaccgaggcctgcgcttaagcctctcagagatcaccgcgacttgcacaggcgaagtcaccaacgtctcaggttgctacagctgcatgacaggcgcaaaagtaagcataaaactacactcctctaaaaactcgacagcccacgtacgctgcaaaggcgacgagaccgcgttcagcgtcctggagggagtacacagctacatagtcagcctcagcttcgaccacgcggtcgtcgacgaacagtgtcaactaaactgcggcggccacgaatcccaagtcaccttaaaaggaaacctcatatttctagacgtgccaaaattcgtggatggcagctatatgcaaacatatcacagcacagtgccaaccggcgcaaacataccatctccaacagactggctgaacgcactcttcggaaacggactcagtcgctggatactaggggtaatcggagtactgctaggcggactggcactattcttcctaataatgttcctcctcaaactcggaaccaaacaagtattcaggtccagaacaaagctagcataa

SEQ ID NO: 16538 - RNA, 3222 nt, synthetic construct
  misc_feature 1..3222: note = derived and/or modified CDS sequence (opt11) from SFTSV/FTLSV(2012YSH86)__KF711939.1__GP
  source 1..3222: mol_type = other RNA
atgatgaaagtcatatggttcagctcactcatttgcttcgttatacaatgctcgggcgactcgggccccatcatatgcgccggaccgatccacagcaacaagtccgccgacatcccacaccttttaggctactcggagaagatctgccaaatcgacagactaatacacgtatcatcgtggctcagaaatcacagccaattccaaggctacgtcgggcaaagaggcggtcgaagtcaggtcagctactacccagccgagaactcatacagtagatggtcgggtctcctcagcccatgcgacgccgattggctaggaatgctagtcgtgaaaaaggccaaaggctcggacatgatcgtccccggaccatcgtacaaagggaaggtcttcttcgaacgtcccactttcgatggatacgtgggatggggctgtggctccggcaaaagccgaacagaaagcggagaactctgcagctcagactccggcaccagctccggactactcccatccgaccgagttctgtggatcggagatgtggcatgccaacccatgaccccgatccctgaagaaacctttctagaactaaagagcttctcgcaaagcgagtttccggacatatgcaaaatcgacggcatcgtattcaaccagtgtgagggcgaatcactcccccaacccttcgatgtagcctggatggacgtcggccactcccataagataattatgagagaacacaaaacgaaatgggtgcaggagtcaagctccaaagacttcgtgtgctacaaagaaggaaccggcccatgctcggaatctgaggagaaaacatgcaagacgtcaggatcgtgcagaggggacatgcagttctgcaaggtcgcaggctgcgagcatggagaagaggcatccgaagcaaaatgccggtgcagcctcgtccacaaaccgggtgaagtcgtggtcagttatggaggaatgcgagtacgacccaagtgtcacggcttctcaagaatgatggccaccctcgaagtcaaccaaccagagcaacggataggacagtgcacgggatgccatctagaatgcataaatggaggcgtacgtctcatcacactcaccagcgaactcaagtccgctaccgtctgcgccagccatttctgctcgagcgcaacaagcgggaagaaaagcaccgagatccaattccacagcggatcgctagtaggaaaaaccgccatccacgtcaaaggggcgcttgtagacgggacggagttcacgttcgaaggctcctgcatgttcccagacggatgtgacgctgtcgactgcactttctgccgggagttcctcaaaaacccccaatgctacccagccaagaaatggctattcatcataatagtaatactcctcggctacgcaggcctaatgctcctgaccaatgtcctcaaagccataggcatatggggcagctgggtaatagcgcctgttaaattaatgttcgcgatcataaagaaactcatgcggacagtttcctgcctaatgggaaaactcatggaccgaggacgccaagtgatacatgaagaaattggcgaaaacagagaaggcaatcaagacgacgtccgaatagaaatggcacgaccccgccgcgtgcgtcactggatgtacagtccagtcatcctaacaatcctcgccataggcctggcagagagctgcgacgaaatggtacatgcggacagtaagctagtgtcatgcagacaaggcagcggcaacatgaaagaatgtgtgacgactgggagagctctcctccctgcagtgaatccaggacaagaggcgtgcctgcacttcaccgcgcccggcagtccggactcaaaatgcctaaaaatcaaagtaaaacgcatcaacctcaaatgcaagaaaagctccagttacttcgtccccgacgcaagatcccgatgcacatccgtacgccgatgccgatgggcgggagactgtcagagcggatgcccaccccacttcacaagcaacagcttctccgacgactgggcgggcaaaatggaccgagcagggctcggtttcagtggctgctcagacggctgtggcggagctgcgtgcggatgtttcaacgccgccccgtcatgcatattctggcgaaaatgggtagaaaacccccacgggataatatggaaagtctcaccatgcgcggcctgggtcccatcggccgtcatagaactaaccatgccaagcggggaggtacgcacgttccacccaatgagcggaatcccaacccaagtttttaaaggcgtcagtgtaacatacctcggctccgacatggaagtaagcggcctaaccgacctctgcgaaatagaagaactaaaatccaagaaattagctctagcaccatgcaaccaggcaggaatgggggtcgtaggcaaagtcggcgagattcaatgctcgtcggaagaatccgcccgcaccatcaagaaagatggctgcatctggaacgccgatctagtcggcatcgaactccgagtcgatgatgcagtctgctactccaaaataacaagcgtagaagccgtagcaaactattcagccatacccacaaccataggaggactccgattcgaacgttcacacgacagccagggcaaaatttccgggagcccactcgacatcacagctataagaggatccttcagcgtaaactaccgcggcctgcgactcagcctgagcgagatcaccgcaacgtgcacaggagaagtcacgaacgtgagcggctgctacagctgcatgacgggggccaaggtaagcataaagctgcacagtagcaagaactcaacagcgcatgtgcgatgtaaaggagacgagaccgccttcagcgtactggaaggagtccacagctacacagtatcactgagcttcgaccatgcagtagtcgatgaacaatgccaactcaactgcggaggacacgaatcccaagtgaccctcaaagggaatctcatattcctcgacgtacccaaattcgtagacggctcatacatgcaaacataccatagcactgtaccaaccggcgcgaacataccctcccccaccgattggctcaacgccctattcggcaacggcctaagtcgctggatacttggggtaatcggcgtcctacttggaggactagccttattcttcatgataatgtcactattcaaactaggaaccaagcaggttctcagaagcagaaccaaactcgcctaa

SEQ ID NO: 16539 - RNA, 3222 nt, synthetic construct
  misc_feature 1..3222: note = derived and/or modified CDS sequence (opt11) from SFTSV/FTLSV(2012YSH89)__KF711935.1__GP
  source 1..3222: mol_type = other RNA
atgatgaaggtaatatggttctcatcactaatatgcttcgtcattcagtgcagcggtgactcaggtcccataatatgcgcagggcccatacactcgaacaagagcgcagacatccctcacctcctagggtactccgagaaaatctgccaaatagacaggctcattcacgtcagctcttggctacgcaaccattcgcaattccaaggatacgtaggccaacgaggcggcagaagtcaagtatcctattaccccgcagaaaacagttactccaggtggtcgggactactctcaccttgcgacgctgactggctaggcatgctagtagtcaagaaagcaaaaggctcggacatgatcgtccccggaccctcatataaaggaaaagtcttcttcgaacgcccgacattcgacggctacgtcggatgggggtgcggcagcggaaagtcaagaaccgaatcgggagaactgtgtagctccgactccggaacttcgagcggtctactaccaagtgaccgagtactctggatcggcgacgtcgcatgtcaacccatgacacccatcccagaagaaacattcctagaactcaagtcatttagccagagcgagttccccgacatctgtaaaatcgacggaatagtgttcaaccagtgtgaaggggaaagcctaccccagccattcgacgttgcctggatggacgtcggccacagccacaaaataatcatgcgagaacacaagacaaaatgggtccaagaatcaagctccaaagacttcgtatgctataaggaagggaccggcccatgctcagagtccgaggagaaaacatgcaaaacaagcggttcctgcagaggcgacatgcaattctgtaaagtagccggatgcgaacacggagaagaggcatcggaagccaaatgccgatgctccctggtacacaaaccaggagaggtcgtagtctcatacggtggaatgcgcgtccgaccgaaatgctacggattctcaaggatgatggcaacactggaagtgaaccagcccgaacaacgcatcgggcagtgcacgggatgccacttagaatgcatcaacgggggagtcagattgatcaccctaacatcagaactaaaaagtgcaaccgtctgcgcaagccatttctgtagcagcgcaacctccggcaagaagagtacagaaatccaattccacagtggctccctagtgggcaaaaccgccatccacgtcaaaggcgcgctcgtcgacgggacagagttcacgttcgaaggctcatgcatgttcccagacggctgcgatgcagtggactgtactttctgccgcgaatttctaaagaacccgcaatgctacccagcaaagaaatggctctttataataatagttatcctcctagggtatgccgggctaatgctcctcacaaacgtgctcaaagccatcggcatatggggctcctgggtcatagcccccgtaaagctgatattcgcaatcataaagaaactcatgagaacggtttcgtgtctgatgggaaaactcatggaccgcgggcgacaggtcatacacgaagaaatcggcgaaaatagggaaggaaaccaagacgacgtacgtattgaaatggcacgcccacgacgcgtacggcactggatgtactcgccggtcattctaaccatcctagccataggcctagccgagagctgtgacgagatggtccacgcagactcaaaactggtaagctgcaggcaagggagcggaaatatgaaggaatgcgttaccacgggacgcgctctgctcccagccgtaaatccgggccaagaagcatgcctgcacttcaccgcacccggcagcccagactcaaaatgcctaaaaataaaagtaaaacgcataaatcttaaatgcaagaaaagctccagttacttcgtaccagatgcgagaagccgctgcactagcgtacgcagatgcagatgggcaggagactgccaaagcggatgcccaccccacttcacatccaacagcttctcggacgactgggccggtaaaatggacagggcaggactcggcttctcaggatgctccgacggatgcggtggcgcggcatgcggctgcttcaacgccgcacccagctgcatcttctggcgcaaatgggtcgaaaatccacacggcattatatggaaagtaagcccctgcgcggcctgggtcccctcggctgtaatcgaacttacaatgccctcaggagaagtaagaacattccaccccatgagcggtatacccacccaagtattcaaaggcgtatcagtcacatatctcggatccgacatggaagtgtccggcctaacagacctgtgcgaaatagaagaacttaaaagcaagaaactggccttagcaccctgcaaccaagctggaatgggggtcgtgggtaaagtaggcgagatccagtgttcttctgaagaatcagcccgcacaatcaagaaagacgggtgcatatggaacgcagacctcgtcgggatcgaactccgggtcgacgacgcggtatgctactctaaaataacatccgtagaagccgtagccaactactcggccataccaacaaccataggcggtctccgattcgagagatcacacgattcacaagggaaaatctctggcagcccccttgacatcaccgcgataagaggctcgttcagcgttaactaccgggggctccgactctccctcagcgaaataaccgccacgtgtacgggcgaggtgacaaacgtctcaggatgctactcctgtatgaccggtgcaaaagtaagcataaaactacacagcagcaagaactcaactgcgcacgtacgatgcaaaggtgacgaggcggccttttccgtactagaaggagtccactcatataccgtctcactgtcattcgaccacgccgtggtggacgaacaatgtcagctaaactgtggcggccacgaaagtcaagtaacactaaaaggcaacctaatattcctcgacgtcccgaaattcgtcgacggcagctacatgcaaacctaccacagcacagttccaaccggcgcaaacataccctccccaaccgactggttgaacgcactcttcggcaacggcctcagccgctggatactcggagtcataggcgtcctcctcggcggcctagcattgtttttcatgatcatgagcctattcaagttagggaccaaacaagttttcaggagccggacaaaacttgcataa

SEQ ID NO: 16540 - RNA, 3222 nt, synthetic construct
  misc_feature 1..3222: note = derived and/or modified CDS sequence (opt11) from SFTSV/FTLSV(2012YSH9)__KF711919.1__GP
  source 1..3222: mol_type = other RNA
atgatgaaagtaatttggttctcgtcactaatatgcctcgtcatacagtgcagcggcgacagcggaccgataatctgcgcaggccccatccacagcaacaaaagcgcaggcatcccacacctcctcgggtacagcgagaaaatctgccagatcgaccggctgatacacgtctctagctggctacgaaaccacagccaatttcaaggatacgtaggccaacgaggtggccgcagccgggtaagttactacccagccgaaaatagttacagtcgctggagcggtctgctgagtccgtgcgatgccgactggctcggcatgctcgtagtgaaaaaggccaaagaatcagacatgatcgtgcccggccccagctataaaggcaaagtcttcttcgaacgacccaccttcgacggctacgtagggtggggatgtggttcgggcaaatcgcgaacagagtcgggagaactgtgttcttctgacagtggaacgagctccggcctactccccagtgaccgagtactatggataggcgacgtagcgtgccaacccatgacccccatcccagaagaaaccttcctcgaactaaaatcattcagccaaagcgagttcccagacatctgcaagatcgacggaatcgtattcaaccaatgcgaaggcgaaagccttccccaaccatttgacgtagcatggatggacgtaggccattcacacaaaataatcatgcgagaacacaaaacaaaatgggtccaagagtcatcaagcaaagactttgtttgctacaaagaaggcaccggaccatgcagcgagtccgaagaaaaggcctgcaaaacctcggggtcctgcaggggcgacatgcaattctgcaaagtggctgggtgcgagcacggcgaggaagcaagcgaggccaagtgccgttgcagcctggtccacaaacctggcgaagtcgtcgtctcgtacggaggaatgagagttcgcccgaaatgctacgggttcagccgaatgatggccaccctcgaagtcaatcgaccagagcaacgcatagggcaatgcacagggtgccacctcgagtgtataaacggaggcgtaaggctcattaccctcacgagcgaactaagatcagcaaccgtatgcgcaagccacttctgctcctccgcaacctcagggaagaagaacacagagatacacttccactccggttcactggttggcaaaacagcgatccacgtcaaaggagcgctagtcgacgggaccgaatttacattcgaaggcagttgcatgttcccagacggctgcgacgcagtcgattgtaccttctgccgcgagtttctgaaaaacccccaatgctatccagcaaagaaatggctattcataatcattgtaatcctcctcggatacgccgggttaatgctccttacaaacgtcctaaaggccatcggagtatggggaagctgggtcatagcaccggtaaaactaatgttcgccataattaagaaactcatgaggacagtatcctgtctggtaggaaaactgatggaccgaggccggcaagtcatccacgaagagattggcgagaacggggaaggcaaccaggacgacgtccgcatcgaaatggcacgaccgcgacgagtacgccactggatgtacagtccggtcatactcacgatactcgcaatagggctggccgagggctgcgacgaaatggtccatgcagacagcaaactggtctcatgccgacaaggaagcggaaatatgaaagaatgcattaccaccggcagagccctgctgccagcagtcaacccaggacaagaggcatgcctgcacttcacggcaccaggcagccccgactcaaaatgcctaaaaataaaagtaaaaagaataaacctcaaatgcaagaaatcaagctcctacttcgtgcccgacgccaggagccgctgcaccagcgtccggaggtgtaggtgggcaggagactgccaatccggctgtcccccgcacttcacaagtaacagcttctcggacgactgggcgggaaaaatggaccgagccggcctcggattctcgggctgcagtgacggctgcggcggcgcggcatgcggatgcttcaacgccgcaccgtcatgcatcttctggagaaaatgggtcgaaaaccctcacggaataatctggaaagtatccccatgcgccgcatgggtcccttccgccgtaatagagctaacgatgccatcaggagaagtgcgaaccttccaccccatgtctggcataccaacacaagtattcaaaggcgtcagcgtcacctacctggggagcgacatggaggtaagcggactaaccgacctttgcgagatagaggaactaaaaagtaagaaactcgcactagctccttgcaaccaagcaggcatgggagtagtagggaaagttggagaaatacaatgctcaagtgaagaaagcgcgcgcacaattaagaaagatggatgcatatggaacgccgatctcgtcggaatagagttgcgagtcgacgacgcggtatgctactccaaaattaccagcgtagaagcagtagccaactatagcgcgatacccacaacaatcggcggactgcgcttcgaaaggtcacacgactcacagggaaaaatcagcggctcacccctagacataacagcaatccgggggtccttcagcgtaaactacagaggactcaggctcagcctgtcagaaataacagccacttgcaccggcgaagtgacgaacgtcagcgggtgttactcgtgcatgaccggcgcgaaagtatcaataaaactacacagcagcaaaaactcaacagcacacgtacgctgcaaaggggacgaaacagcattctccgtcttagaaggcgtccatagctacatcgtctcactctcgtttgatcacgccgtggtcgacgaacaatgccaactcaactgtgggggacatgagtcgcaagtcaccctcaaaggcaacctgatcttcctggacgttccgaaattcgtagatggaagctacatgcaaacctaccactcaacagtaccaacaggtgctaacatcccttccccaacggactggctcaacgcactattcggtaatggactctcacgatggatacttggggtcatcggagtcttactcggcggcctggccctctttttcctgataatgttccttctaaaactaggaacaaaacaggtgtttagaagccgcaccaaactggcgtga

SEQ ID NO: 16541 - RNA, 3222 nt, synthetic construct
  misc_feature 1..3222: note = derived and/or modified CDS sequence (opt11) from SFTSV/FTLSV(2012YSH91)__KF711920.1__GP
  source 1..3222: mol_type = other RNA
atgatgaaagtaatatggttcagctcactcatttgccttgtcatccaatgctccggtgactcaggaccaatcatttgtgcaggccccattcactcgaacaaaagcgcaggcataccgcacctcctaggttactcggagaaaatatgccaaatcgacaggctgatccacgtatcctcctggctgaggaaccactcccaatttcaaggctacgtaggccagcgaggcggacgctcacaagtcagctactaccccgcagaaaatagctattcgcgctggagtggcctcctctccccatgcgacgcagactggctaggcatgctcgtagtaaagaaagcgaaagaatcagacatgatagtaccaggacccagctacaaaggcaaagtattcttcgaacgacccaccttcgacggatatgtcggctggggatgcggcagcggaaaaagtcgaacggaaagcggagaactctgtagctccgacagcggtaccagtagcggattactgcccagcgaccgagtcttgtggataggcgacgtagcctgccaacccatgactccgatccacgaagagacctttctagaactaaagagcttctcgcaaagcgagttcccagatatctgcaaaatagatggcatagtattcaaccaatgcgaaggcgaatccttgccccagccattcgacgtagcctggatggacgttggacactcccataaaatcataatgagggaacacaaaaccaaatgggtccaagaatcctcgtcaaaagatttcgtctgctacaaagaaggcacgggcccctgctccgaaagcgaggaaaaagcgtgcaaaacaagcggtagctgcagaggggacatgcagttctgcaaggttgcaggctgcgagcacggagagaaggcgagcgaaaccaaatgcagatgtagtctcgtccataagccgggcgaagttgtcgtgagctacggaggaatgagagtaagaccaaaatgctacggaatctcacgaatgatggccaccctagaggtaaacccgccagaacaacgaatcgggcaatgcacagggtgccacctcgagtgtatcaacggcggggttcgactcatcacactgacgtcagaactgaggtccgccacagtctgcgccagtcatttctgctccagcgcatcaagcggcaaaaagtcaacggaaatacacttccactcaggaagtctagtaggcaaaacggccatccacgtgaaaggcgccctcgtcgacgggaccgagttcacgtttgagggaagctgcatgttcccagacggatgcgatgccgtcgactgtaccttctgccgcgagttcctcaagaaccctcaatgctacccagccaagaaatggctattcatcatcatcgtaattctcctaggatacgcgggcctaatgctcctaacaaatgtactgaaagcgatcggagtatggggatcctgggtaatcgcacccgtcaagctaatgttcgcaataataaagaaactcatgaggacagtatcatgcctagtcggcaaactcatggaccgaggacggcaggtcatacacgaagagataggcgaaaacggcgaaggaaaccaagacgatgtaaggatcgagatggcaagaccacgtagggtacgccactggatgtacagcccagtcatactaactatccttgccataggcctcgcagaaggctgcgacgagatggtacacgcagactccaaactcgtatcatgccggcaaggatcagggaacatgaaagaatgcataaccacaggacgcgccctcctacccgccgtaaaccccggccaagaagcatgtctccactttacagcgccgggatccccagactcgaaatgcctaaagataaaagttaaacgaataaacattaaatgcaagaaaagctctagctacttcgtacgagacgcccgctcacgctgcacgagcgtacgacgatgccgatgggccggagattgccaaagcggctgtccaccccatttcacatccaacagcttcagcgacgactgggccggcaaaatggaccgcgcggggctaggatttagtggatgcagcgacgggtgcggaggagcagcctgcgggtgcttcaacgcagcccccagctgtatattctggagaaagtgggtcgagaacccccacggcatcatctggaaagtctcgccctgcgcagcatgggtaccctccgcggtcatcgaattgaccatgccatcaggcgaagtgcgcacattccacccgatgtcaggaataccgacacaagtcttcaaaggcgtctcagtaacctatctaggatcggacatggaggtctctggactcactgacctctgcgaaatagaggaactaaaaagcaagaaactcgccctagcaccttgcaaccaagcaggaatgggagtagtcggaaaggtcggagaaaaacaatgcagcagcgaagaatccgcaagaacaattaagaaagacggctgcatatggaacgcagacctggtcggaatagaactaagagtcgacgacgcagtgtgctacagcaaaataacaagcgtagaggcagtagccaattactcggccattccgacgaccataggcgggttgagattcgagcgatcacacgacagccagggaaagatctcgggctcgcccctggacataaccgcaatcagaggttcattctccgtcaactacaggggtctgcggctgagtctaagcgagatcacagcgacctgtaccggcgaagtcacaaacgtcagcggctgttactcgtgcatgacgggtgctaaggtatccatcaaacttcacagcagcaaaaacagcacagcacacgtaagatgtaaaggagacgagacagcgttcagcgtgttagagggggtccactcctacatagtcagcctatcatttgaccacgcagtcgtggacgagcagtgccaactaaactgcggcggacacgaaagccaagtgaccctaaaaggcaacctaatattcttggacgttccgaaattcgtggatggctcatacatgcaaacgtaccacagcacagtaccgaccggtgccaacatcccaagcccaaccgactggctgaacgcactatttggaaacggactaagccgatggatactaggagtcatcggggttctactagggggcctagcgctgtttttcctaatcatgttcctcctgaaactcggaacaaaacaagtctttagaagcaggaccaagctcgcataa

SEQ ID NO: 16542 - RNA, 3222 nt, synthetic construct
  misc_feature 1..3222: note = derived and/or modified CDS sequence (opt11) from SFTSV/FTLSV(2012YSH92)__KF711941.1__GP
  source 1..3222: mol_type = other RNA
atgatgaaggtcatatggttctcctcactaatttgcttcgttatacaatgcagcggtgacagcggaccaatcatatgcgcgggaccaatccactccaacaaatcagcggacataccacacctattggggtactcagaaaagatatgccagatagacagactcatacacgtatcctcgtggctacgcaaccatagccaattccaaggatacgttggccaaagaggaggacggagtcaagtcagctactacccagcagaaaactcgcacagcagatggtcaggactcctaagcccatgtgacgcagactggctcggcatgctggtcgtcaagaaagccaaaggcagcgacatgatagtaccaggcccctcatacaaaggaaaggtattcttcgagcgcccgaccttcgacggttatgtcggctggggatgcggctccggaaaatcccgcaccgaatccggcgaactgtgctcaagtgactccgggacgagctccgggctactgcccagcaatcgagtactctggataggagacgtggcgtgccaacccatgaccccgataccagaagagaccttcctggaactcaagagctttagccaatccgagttcccggacatatgcaagatcgacggaatagttttcaaccaatgcgaaggggagagcttaccacagccattcgacgtcgcctggatggatgtcggccactcccacaaaataatcatgcgagaacacaaaaccaaatgggtccaggaaagcagcagcaaagacttcgtgtgttacaaggaaggaacaggcccgtgttcagaatccgaagaaaagacatgcaaaaccagtggttcgtgccgaggagacatgcaattctgcaaggtagcaggctgcgaacacggggaagaagcctcagaagccaaatgcagatgcagcctggtacacaaacccggcgaagtagtagtcagctacggcggaatgcgggttcgtccaaaatgctacggcttctctaggatgatggcaaccttggaagtaaaccaaccagagcagagaataggacaatgcaccggatgccatctagagtgcatcaacgggggtgttagactcatcactctcacctcagaactaaaaagcgcaaccgtatgcgcgtcccacttttgctcctccgcgacaagcggcaagaaaagtacagaaatacaattccactccggctcgcttgtaggaaaaaccgccatccacgtcaaaggcgcgctcgtggacggcacagaatttacattcgaaggctcatgcatgtttccggatggatgcgacgcagtcgactgcacattttgcagagagttcctcaaaaatccgcaatgctacccagcgaagaaatggctattcataataatagtcatcctgctcggctatgcgggcctaatgctcctgacaaacgtactaaaagcaatcggcatctggggatcgtgggtaatcgcaccggtaaaactcatattcgcgataatcaagaaactcatgagaacagtgagctgcctaatgggcaaactcatggaccgcggaagacaagtcatacacgaagaaataggcgaaaatagagaagggaaccaggacgacgtcagaatagagatggcaagaccccgaagagtcagacactggatgtactcaccggtcatattaacaatcttagccatcggcctagcggaaagttgcgacgaaatggtacacgccgattccaagctagtcagctgcaggcaaggcagcggtaacatgaaagagtgcgtcactacggggcgggccttactccccgccgtgaatccaggacaagaagcgtgcctacacttcacagcacccggcagtccagacagtaaatgcctgcgcataaaagtcaaacgcatcaacctaaagtgcaagaaaagctcaagctatttcgtgccagacgccagatcccgatgcacaagcgtgcgaagatgcagatgggcaggcgactgccagtctgggtgcccaccccacttcacaagcaactccttctcagacgactgggccgggaaaatggaccgggcaggactcggtttcagcggctgctccgatggctgcggcggagcagcgtgcgggtgcttcaacgctgcaccaagctgcatattctggcgaaaatgggtagaaaaccctcacgggataatctggaaagtcagcccctgtgcagcttgggtccccagtgccgtaatagagctaacgatgccatccggggaagtccgaacattccacccaatgtccgggatccccacacaggtcttcaaaggagtaagcgtcacctacctcggcagcgacatggaagtctccggacttacagatctatgcgaaatagaagaactaaaatccaaaaagctcgccctcgcgccatgcaatcaggccgggatgggggtcgtggggaaggttggcgaaatacaatgcagcagcgaagaaagcgcccgaacgataaagaaagacggatgcatatggaacgccgacctcgtcggcatcgagctaagagtagacgacgcggtctgctactcgaaaatcacaagcgtggaagccgtcgccaattactcggcaatcccaacgaccataggcggcctcagattcgaacgatcacacgactcacagggaaaaatctccggctcccccttagatatcacagccataaggggctccttctcagtaaactacagaggactgcgactctccctaagcgaaataaccgccacatgcaccggagaagtcacaaacgtctcaggatgctactcttgcatgacaggtgccaaggtaagcataaaactgcacagctccaaaaactcgaccgcacacgtaagatgtaaaggcgacgaaacagccttctcagtcctcgagggcgtccatagctacaccgtaagcctgagctttgaccacgccgtagtcgacgaacaatgccaactcaattgcggaggccacgaatcccaagtcaccctgaagggcaacctaatctttttagatgtacccaaattcgtcgacgggtcctacatgcaaacataccacagcacggtgcccacgggagcaaacatcccaagtccaaccgactggcttaacgccctcttcggcaacggactttcccgctgggttctgggagtcatgggtgtgctcttaggtgggctcgcactcttcttcatgatcatgagcctgtttaaactcggaaccaagcaagtattcagaagcagaacaaagctcgcgtaa

SEQ ID NO: 16543 - RNA, 3222 nt, synthetic construct
  misc_feature 1..3222: note = derived and/or modified CDS sequence (opt11) from SFTSV/FTLSV(2012YSH93)__KF711946.1__GP
  source 1..3222: mol_type = other RNA
atgatgaaagtgatctggttctcatcactcatatgcttcgtcatccaatgttcgggagactctggacctatcatatgcgcgggacctattcactccaacaaatcagccgacatcccacacttgctcggttactccgaaaaaatatgccaaatagataggctaatacacgtaagctcgtggctaagaaaccacagccagttccagggttacgttggccaacgcgggggacgaagtcaggtatcatactatccagcagaaaactcctacagccgatggagtggcctattatcaccctgtgacgccgactggcttggtatgctggtggtcaaaaaggccaagggcagtgacatgatagtaccaggcccaagctacaagggaaaggtcttcttcgagcgcccaacattcgacgggtatgtaggctggggatgcggaagcggcaaaagccgaaccgaaagcggcgagctatgctccagtgacagcgggaccagctcaggattgctaccatcaaacagggtcctatggattggtgacgtggcatgccaaccaatgacgccaatccccgaggaaacctttctcgaactaaaatccttctcccaatcagagttccccgacatatgcaagatcgacggcatagtattcaaccaatgcgaaggcgagtccctgcctcagccattcgatgtcgcctggatggacgtaggacactcacacaagatcataatgagagaacacaaaacaaaatgggtacaagagtccagctctaaagactttgtctgctacaaggaaggaaccggaccatgctccgagagcgaagaaaaaacatgcaaaacgtcaggatcgtgcagaggagacatgcaattctgcaaagtagcaggatgcgaacacggcgaagaagcatcggaagcaaaatgcaggtgttcactagtacacaaacctggagaggtagtagtatcatacgggggcatgcgcgtacgcccgaaatgctacggcttctcccgcatgatggccacgctagaagtcaaccagcccgaacaaagaatcggacaatgcaccggatgccatctcgaatgcatcaacggcggcgtgcgcttgatcaccctcaccagcgaacttaaaagcgcgaccgtatgcgcaagtcatttctgcagttccgcgacatcagggaaaaaaagcacagaaatacaattccactcaggctcgctcgtcggaaagacggcaatacacgttaaaggagccctcgtcgacgggacagaattcacattcgagggcagctgcatgttcccagacggatgcgacgctgtcgactgcacgttctgcagggaatttttaaaaaacccgcaatgctacccggcaaagaaatggctattcataataatcgtaatcctactaggctacgcaggcctcatgctactaactaacgtgcttaaggcaatcggcatctggggaagctgggtaatagccccagtcaagctaatcttcgcaataattaaaaaactaacacgcacagtctcatgcttgatgggcaaactaatggatcgcggacgccaagtcatccacgaggaaatcggagagaaccgggaagggaaccaggacgacgtccgaatagagatggcacgcccaagacgagtcaggcactggatgtacagccccgtaattcttacaatcctagccataggtctcgccgaatcctgcgatgaaatggtgcacgcagactccaagctagtgtcctgccggcaaggaagcgggaatatgaaagagtgcgtgacaacggggagggcactactgccagctgttaatccaggccaggaagcgtgcttacacttcaccgcacccggaagtcccgactcaaaatgcctcaaaatcaaagtcaagcgaatcaacctgaaatgcaaaaaatcgtcgagctacttcgtcccagacgcaaggtacagatgcacaagcgtccgaagatgccgctgggcaggcgactgccaaagcgggtgcccaccccatttcacaagcaatagtttcagcgacgactgggctggaaagatggaccgcgccggcctgggattctctggctgcagcgacggctgcggaggcgcagcgtgcggttgcttcaacgcagcgccaagctgcatattttggagaaaatgggtcgaaaacccacacgggatcatatggaaagtcagtccatgcgcagcatgggtaccttccgcggtaatagagctcaccatgccatccggcgaagtgcgcacatttcacccaatgtccggaatccccacacaagtcttcaaaggagtatcagtaacatacctaggatcggacatggaggtatcggggcttaccgacctctgcgagatcgaggaattaaagtccaaaaaactagccctagcaccctgcaaccaggcgggcatgggagtcgtgggaaaagtaggggaaatacagtgcagctcagaagaatccgcacgcacaataaaaaaagacggctgcatctggaacgcggaccttgtagggattgaactcagggtagacgatgcagtatgctactcaaaaataaccagcgtcgaggcagtggcaaactactccgccatacccactaccatcggcggattacgatttgagcggagccacgactcccaggggaagatcagcggatcgccactggacataaccgcgatcaggggatcattctccgtcaactaccgaggacttcgcctgtccctcagcgaaataacagccacttgtaccggcgaggtgacaaacgtcagcggctgctactcatgcatgacaggagccaaagtcagcatcaaactccactcaagcaaaaactcaacagcgcacgtccgctgcaaaggggacgagaccgcgttctccgtcctggaaggtgtccacagctatacggtcagcctctccttcgaccacgctgttgtggacgaacaatgccagctaaactgcggcggacacgagagccaggtgacactgaagggaaatctaatctttctcgacgtacccaagttcgtagacggcagctacatgcaaacataccacagcacagtacccaccggggccaacataccatccccaaccgactggctcaacgcacttttcgggaacggcctatcacgctgggtcctcggggtaatgggggtacttctgggagggctcgcactattcttcatgatcatgagcctcttcaaactcggaacaaagcaagtcttccggtcacgaaccaagctcgcataa

SEQ ID NO: 16544 - RNA, 3222 nt, synthetic construct
  misc_feature 1..3222: note = derived and/or modified CDS sequence (opt11) from SFTSV/FTLSV(YGS1)__KF356537.1__GP
  source 1..3222: mol_type = other RNA
atgatgaaagtaatatggttcagctcgcttgtttgcttagtcatacaatgcagtggggactcaggaccaatcatatgtgcaggcccaatccacagcaataaatccgcagctatacctcacctactcggatactcagaaaagatctgccaaatagataggctaatacacgtgtcctcgtggctacgcaaccacagtcaattccaagggtacgtaggacaacgcggaggccgaagccaagtctcgtactacccagcagaaaacagctacagcagatggtcaggcctgttatcaccctgtgacgcagactggctcggcatgctcgtcgtcaagaaagccaaaggctcggacatgatcgtccccgggccctcgtacaagggcaaagtattcttcgaacgccccactttcgacggttacgtcgggtggggatgcggaagcggaaaatcacggacagaatccggtgaactgtgctccagcgacagcggaacgtccagcggactcctgccctccgatagggtgctatggataggagacgtcgcgtgccagccaatgacccccatccccgaagaaacattcctcgagctcaaatcattcagccaaagcgagttcccagacatctgcaaaatagacggaatagtgttcaaccaatgcgaaggggagagcctaccccaaccattcgacgtcgcctggatggacgtcggccatagccacaagataataatgagagaacacaaaacgaaatgggtacaggaaagttcctccaaggactttgtatgttacaaggagggaacaggcccatgctccgagtcggaagagaaggcttgcaaaacaagcggctcatgccggggagatatgcagttctgcaaagtcgcaggatgtgagcacggagaggaagcctcggaggcaaaatgccgctgctccctcgtccacaaacctggcgaggtcgtcgtcagctacggaggaatgcgcgttagaccgaaatgctacggattctccagaatgatggccaccatggaagtaaacccacccgagcaaagaatcgggcaatgcaccggatgccatctcgaatgcataaacggaggcgtgcgcctaatcaccctcacaagcgaactcaaaagcgcgacagtctgcgcatcacacttttgcagctcagcaacaagcgggaaaaagtctacggaaatccacttccactccggttccctagtcggaaaaaccgcgatacacgtaaaaggcgcactcgtagacggaaccgagttcacattcgaaggcagctgcatgttcccagacggctgcaacgcagtcgattgcaccttttgcagagagttcctcaaaaacccgcaatgctatccagccaagaaatggctattcattattatcgtgatactactcggatacgccggcctaatgctcctcaccaacgtcctaaaagcaataggagtctggggcagctgggtaatagccccggtaaaactgatgttcgccataatgaaaaagctaatgagaacagtcagctgcctagtaggaaaactaatggatagagggcgccaggtcatacatgaagaaataggggaaaacggtgaaggaaatcacgatgacgtgcgcatagaaatggcacgtccccgcagggtccgtcactggatgtactcccccgtaatccttacaatactagccataggactagcagaggggtgcgacgaaatggtacacgccgactcaaaactggtcagctgtagacaaggaagcgggaacatgaaagagtgcgtcaccaccggccgagccctgctcccatccgtaaaccccgggcaagaagcatgcctacatttcacagcgccgggaagcccagacagcaaatgcctaaaaatcaaagtgaaacgcatcaacctcaaatgtaagaagagtagcagctacttcgtcccagatgccagaagccggtgcacgagcgtgcgaagatgccgctgggcgggggactgccagtccggctgcccgccccacttcacgagcaacagcttcagcgacgactgggccggaaagatggaccgagcagggctcggattctcgggctgtagcgatggctgcggaggagccgcatgcgggtgcttcaacgccgccccatcatgcatattctggcgcaagtgggtcgagaactcacacggaatcatatggaaagtgtccccgtgtgccgcgtgggtgccgtcggccgtgatcgagctcacaatgccgagcggcgaggtacgcacgttccaccccatgagcggcattcccacgcaagtcttcaaaggggtctcagtcacctacttagggtcagacatggaagtaagtgggctcacagacctatgcgaaatcgaggaactgaaaagcaaaaagctagcactcgccccctgtaatcaggcaggcatgggagtcgtaggtaaagtaggtgaaattcaatgctcctccgaagagagcgcacgcacaataaagaaagacgggtgtatatggaacgcagacctggtcggtattgaactccgcgtagacgacgcggtctgttactcgaaaataacaagcgtagaagccgtagccaattactctgctatccctaccacaatcggcggactcaggttcgagcgcagtcacgacagccagggcaaaatctcgggatcgccactggatatcaccgcaatccggggctctttctccgtcaactacagaggattgcgactgagcctaagcgagattacggccacatgcaccggagaggtaacgaacgtaagcgggtgctacagctgcatgacaggtgcaaaagtcagcatcaaattacacagctcgaaaaactccaccgcccacgtgagatgcaaaggagacgagaccgcattctcagtccttgaaggagttcacagctacacagtgagcctcagctttgaccacgctgtggtggatgaacaatgccaactcaactgcggaggacacgaatcccaagtaacgctaaaaggaaacctaatattcctcgacgtcccgaaattcgtcgatggaagctacatgcaaacgtaccactccaccgtaccaacaggggcaaatatcccaagcccaacggactggctgaatgcactgtttggcaacggactatcgagatggatcctaggggtcataggcgtgctgctaggaggtctagcattattcttcctcatcatgttcctctttaaactaggaacgaagcaagtcttcagatcacgaaccaaactggcgtaa

SEQ ID NO: 16545 - RNA, 3222 nt, synthetic construct
  misc_feature 1..3222: note = derived and/or modified CDS sequence (opt11) from SFTSV/FTLSV(YNY1)__KF356538.1__GP
  source 1..3222: mol_type = other RNA
atgatgaaagtgatatggttcagcagccttatatgcttcgtaatacaatgcagcggcgacagcggcccaatcatctgtgcgggccccatccatagcaacaaatcggcagacatcccgcacctgttaggctactcagagaaaatctgccaaatagaccgcctcattcatgtctccagttggctccgaaatcactcgcaattccaagggtacgtcgggcagcgaggtggacgatctcaggtatcgtactatcccgcggaaaactcctacagcagatggagcggcctactgtcaccctgcgacgcggactggctaggaatgctggtcgtcaaaaaggccaaaggctcggacatgatcgtacccgggccaagctacaaaggaaaagtattcttcgaacgaccgaccttcgacggatacgtcggctggggctgcggctcaggcaaaagcaggacagaatcgggcgaactctgctcaagcgacagcggcacttccagtggactactaccctcggacagagtcctatggataggggatgtagcatgccaaccaatgactccgatacccgaagaaaccttcttggaactcaagagcttcagccaaagcgagttcccggacatctgtaaaatcgacggcatagtcttcaaccagtgcgaaggtgaaagcctcccccaacctttcgacgtggcctggatggacgtgggccactcgcacaaaatcatcatgcgagaacacaagacaaaatgggtgcaggaaagcagctcgaaggacttcgtgtgctacaaggaaggtacgggaccctgctcagaaagcgaagagaaaacatgcaaaacctcgggcagctgccggggcgacatgcaattttgtaaagtggcaggctgcgagcatggagaagaggcatcggaagcaaagtgccggtgcagcctcgtgcacaaaccaggcgaggtggtggtctcatacggcgggatgcgagtacgcccaaaatgctacggtttctcacgcatgatggcgaccctagaagtgaaccagcccgagcagagaatcggccaatgcacagggtgccacctggagtgtatcaacggaggagtccgcctaataacactaacaagcgagctcaaatccgcgaccgtatgcgcaagccacttctgtagcagcgccacaagtgggaagaaaagcaccgaaatacaattccattcgggaagcctagtagggaaaaccgcgatacacgtaaaaggcgcgctcgtcgatgggactgagttcacgtttgagggatcatgcatgttcccagacggatgcgacgcagtcgactgcaccttttgccgagaatttctcaaaaacccgcaatgctaccctgccaaaaagtggctattcataataatagtaatactgttcggctacgcaggactaatgttactaacaaatgtcctgaaagccataggcatatggggaagctgggtcatagccccggtcaaactcatcttcgccataatcaaaaagctaatgcggaccgtcagctgcctaatgggaaaactaatggaccgagggcgccaggtcatacacgaagagataggcgagaacagggaaggaaaccaggacgacgtacgaatagagatggcaaggccccgcagagtcagacactggatgtacagtccagtcatactgacgatcttagcaattggactagcagaaagctgcgacgaaatggtccatgcagacagcaaactggtgagctgccggcaaggatcagggaacatgaaagaatgcgtcaccacagggagagccctactccccgcagtgaacccagggcaagaagcgtgcctacatttcaccgcgcccgggagccccgactcgaaatgtctcaaaatcaaggtcaaacgaattaacctcaaatgcaaaaagtcatcaagctattttgtacccgacgcacggagccggtgcacaagtgttcgaaggtgtaggtgggcgggcgactgccagagcggctgcccgccacacttcacaagcaacagcttctcagatgactgggccggcaaaatggaccgggccgggctggggtttagtggctgcagcgatggctgcggaggggcagcatgcggatgcttcaacgccgccccgagctgcatcttttggagaaaatgggtcgaaaaccctcatgggatcatatggaaggtaagcccatgcgctgcgtgggtgccctcagccgtgatcgaactcacgatgccgagcggcgaagtgagaacattccaccccatgtcaggtatccccacacaagtgttcaaaggggtcagcgtcacataccttggatccgacatggaggtaagcgggttaaccgacctgtgcgaaatcgaggaactaaaatcaaagaaactagcactcgccccctgtaaccaagcgggcatgggcgtcgtaggcaaagtcggggaaattcaatgctcatccgaagaatccgcccgaacgatcaagaaggacggatgcatatggaatgccgacctagtaggaatagaattaagggtcgacgacgcggtctgttacagcaaaataacctcagtagaggcggtagccaactacagcgccatccccaccaccatcggaggcctgaggttcgaacgctcacacgacagccaaggtaaaatatcagggtcgcccctcgacatcactgcaatacgtggcagctttagcgtgaactacagaggactaaggctaagcctgtcagagatcaccgcaacctgcacaggagaagtgacaaacgtgagcggttgctacagttgcatgacgggcgccaaagtaagcataaaattgcacagcagcaaaaattcaacagcccatgtacgctgcaaaggggacgagacagccttcagcgtcttggaaggagtacacagctacactgtcagcctcagcttcgaccacgccgtggtcgacgaacaatgtcaactcaattgcgggggccacgaatcgcaagtaacactaaaaggaaacctaatcttcctagacgtcccgaaattcgtggatggctcgtacatgcaaacgtaccacagcacggtaccgacgggagctaacatcccgtccccaaccgactggttaaacgcactctttggcaacggactaagccgctggatactaggggtaatgggcgtgctcctaggcggactcgccctctttttcatgataatgtccctgttcaaactcggaaccaaacaagtattcaggagtcgaaccaaactcgcataa

SEQ ID NO: 16546 - RNA, 3222 nt, synthetic construct
  misc_feature 1..3222: note = derived and/or modified CDS sequence (opt11) from SFTSV/FTLSV(YPQ133)__KF356530.1__GP
  source 1..3222: mol_type = other RNA
atgatgaaagtaatctggttctcctcactgatatgcttcgtaatacagtgcagcggcgactccagccccatcatctgcgcggggccaatccacagcaacaagtctgccgacataccccacctattagggtacagcgaaaagatctgccaaatagaccgactcattcacgtatcatcctggctacgtaatcactcgcaattccaaggctacgtaggccaaagagggggacgcagccaagtctcctactatccggccgaaaacagctacagccgatggtccggactcctctccccttgtgacgccgactggttaggcatgctggtggtcaaaaaggccaaaggctccgacatgatagtaccaggaccaagctacaaaggaaaagtattcttcgaaagacccaccttcgacggatacgtaggctggggctgcggaagtggaaaaagccgaacagaatcaggggaactgtgcagcagcgactcaggaacctccagcggcctcttacccagcgaccgagtcctatggataggagacgtcgcctgtcaacccatgaccccaataccggaagagacatttctcgagctaaaatcattcagccaaagcgagttccccgacatatgcaaaatcgatggcatcgtattcaaccaatgcgaaggagaaagccttccccagcccttcgacgtcgcctggatggacgttggacatagccaaaagataataatgcgagaacacaagacgaagtgggtccaagaatccagctcaaaggactttgtctgctacaaagaaggcaccggaccatgctcggaaagtgaggagaaaacctgcaaaacatcgggatcatgcagaggagacatgcagttctgcaaagtggccggctgcgagcacggggaggaagccagcgaagcaaaatgcagatgcagcctcgtacacaagcccggtgaagtcgtggttagctacggaggaatgcgcgtccggccaaagtgttacggcttctcacgcatgatggccaccctcgaggtcaatcaaccagaacaaagaataggccaatgcaccggatgccacctcgaatgcatcaacggaggggtgagactcataaccctgactagcgaactcaaatccgcaaccgtctgcgcaagccacttctgcagctcagcaacatccgggaaaaagagcacggaaattcaattccacagcggaagcctagtaggaaagacagccatccacgtcaagggagccctagtcgacggaacggaatttacattcgaaggctcgtgcatgttcccagacggctgcgacgcggtcgattgcacattttgcagagagttcctcaaaaacccacaatgctacccggcaaagaagtggcttttcataataatagtgatcctactcggatacgccggcttaatgctactcaccaacgtcctcaaagccatcgggatatggggaagctgggtaatcgcaccagtgaaactcatattcgcaataataaagaaactgatgagaaccgttagctgtctaatgggcaaactcatggaccgcggaaggcaagtcatacacgaagagatcggcgaaaaccgagagggcaaccaggacgacgtgcggatagaaatggcacgacctcggagagttcgacattggatgtacagtccggtaatactcacaattctggccataggcctcgcagaaagctgcgacgaaatggtccacgctgattcaaagctagtgtcatgcagacagggcagtggaaacatgaaagaatgtgttaccacaggccgagcattgctaccagctgtaaacccgggccaagaagcgtgcttgcacttcacagcacccggctcaccggacagcaaatgcctaaaaataaaggtcaaacgaatcaacctcaaatgcaagaaaagtagcagttacttcgtacccgacgccaggagccggtgcacgtccgtaagaagatgtaggtgggcaggggactgccaatcaggatgcccaccccactttaccagcaacagtttttccgacgactgggccggaaaaatggaccgcgccggcctcggattctccggctgctcggacggctgcggcggcgcggcatgcgggtgcttcaacgcggcccccagctgcatattctggagaaaatgggtcgagaacccacacggggtaatatggaaagtcagcccctgcgcagcatgggtaccctcagccgtaatagagctcaccatgcccagcggtgaagtccgcacatttcacccgatgagcggaatcccgacacaagtgtttaaaggggttagtgtaacctacctaggctccgatatggaagtatccggccttacagatctatgtgagatagaggaactgaaatccaaaaagctcgcgctcgcaccctgcaaccaggcaggaatgggggtcgtagggaaggtgggagaaatacaatgttcatcggaagaatcggcccgaaccataaagaaagacggctgcatctggaacgcagacctagtcggaatcgagctaagagtagacgacgccgtctgttactccaaaataacctcagtagaagcagtggccaactactcagcaatcccaaccacaatcggcggactacgattcgaacgcagccacgactctcagggaaaaatctcaggaagccccctagacataaccgccataaggggctccttttcagtaaactacagaggcctccgactttcccttagtgaaataacagcaacctgcacgggcgaagtaaccaacgtttcagggtgttattcatgcatgaccggcgccaaagtcagcatcaagctgcactccagcaaaaactccacagcgcacgtgaggtgtaaaggcgatgaaaccgcattctccgtcctcgaaggtgtccattcctacacagttagcctctccttcgaccacgccgttgtcgacgaacagtgccaactcaattgtggaggccacgaatcgcaggtcaccctcaaaggcaacctgatcttcctagacgttccaaaattcgtcgacggatcatacatgcagacataccactccaccgtacccaccggggcaaacatcccaagcccaaccgactggctcaatgcccttttcggcaacggacttagccgttggatactcggcgtcatgggcgtgctgctaggaggactagcactcttcttcatgataatgtccctattcaagctgggaaccaaacaagtcttcaggtccagaactaaactggcgtaa

SEQ ID NO: 16547 - RNA, 3222 nt, synthetic construct
  misc_feature 1..3222: note = derived and/or modified CDS sequence (opt11) from SFTSV/FTLSV(YPQ2)__KF356531.1__GP
  source 1..3222: mol_type = other RNA
atgatgaaagtcatctggttcagcagtctaatatgctttgtgatacaatgctcaggagatagcggcccaatcatatgcgcgggacccatccacagtaacaaatcagcggatataccccatctcctcggatactcagagaaaatctgccaaatagacaggcttatacacgtgagcagctggttgcggaatcacagccaattccaaggatacgtaggacaacgcgggggcaggtcccaggtatcatactaccccgcagaaaacagctacagccgatggagcggactgctatcgccatgcgacgctgactggctgggaatgcttgtcgttaaaaaggcaaaaggctcagacatgatagtaccaggaccatcatacaagggaaaggtattcttcgaacggccgacattcgacggctacgtgggatggggctgcggcagcggcaagtccagaacagaaagcggcgaattgtgctcaagcgacagcggcacctcgagcggccttctcccctcagatcgcgtactgtggatcggcgacgtagcttgccaacccatgacccctatcccagaggaaacctttctggagctcaagagcttcagccaaagcgagttcccggacatatgcaaaatcgatggaatagtcttcaatcaatgcgaaggagaaagccttccccaacccttcgacgtagcgtggatggacgtgggacacagccacaagattatcatgagagagcacaaaacgaaatgggtccaggaatcaagcagtaaggacttcgtctgttacaaagagggcacaggaccctgctcagagtcggaggagaaaacatgcaagacctcgggctcatgccggggcgacatgcaattctgcaaggtggcaggatgtgaacacggagaagaagcatccgaagcgaagtgtcgctgctccctggtgcataaaccgggagaagtcgtggtcagctatggcggcatgagagtgcgcccaaaatgctacggattcagccgaatgatggccaccctcgaagtcaaccaaccagaacaacggatcggacaatgcacagggtgccacctagagtgcataaacggtggagtgcgcctaataacactgacttccgagctcaaatcagcaaccgtatgcgcatcacacttttgtagctcagctacaagcgggaagaaaagcacagaaatacaattccactcggggagcctcgttggcaaaatagcaatacacgtaaaaggagcgctcgtcgacgggaccgagttcaccttcgagggatcttgcatgtttcccgacggctgcgacgcagtggactgcacgttctgcagagagttcctcaaaaacccccaatgctatccggcaaagaaatggctattcatcataatcgtcatcctcctcggctacgcgggcctgatgctcctcaccaacgtgctaaaggcgatcgggatctgggggagctgggtcattgcacccgtaaaactgatctttgcaataatcaaaaagctcatgcgaactgtcagctgcttaatggggaaactaatggaccgaggccgccaggtcatacacgaagaaataggagaaaaccgagaaggaaaccaagacgacgtcaggatagagatggctcgcccgcgacgagtacgccactggatgtactcaccagtgatactaacaatactagccatcggactcgcagagtcctgcgacgaaatggtccatgcagactcaaaattggtctcctgccgacaggggtcgggcaacatgaaagaatgcgtaaccacgggacgagccctgctgcctgcagtaaacccaggacaagaggcatgcctccactttacggctccgggcagcccagactccaaatgcctcaagatcaaggtaaaacggataaacctcaaatgcaaaaagagcagcagctacttcgtgccaatggcaagattcagatgcacgagcgtcaggcggtgccgatgggcgggcgactgccagagcggatgcccaccacacttcacgtccaacagcttctcagacgactgggcagggaaaatggacagagcaggcctcgggttctcgggatgcagtgatggttgcggcggggcggcatgcgggtgcttcaacgcagcgccaagttgcatcttctggagaaaatgggtcgagaacccacacggaatcatatggaaggtcagcccttgcgcagcgtgggtcccatcggcagtaattgaacttacgatgcccagcggggaagtaagaacattccaccctatgagcgggatcccaacacaagtcttcaaaggggtcagcgtcacatacctcggctcagacatggaagtaagcggactcacggacctgtgcgagatagaagaattgaaatcaaagaaacttgcactagcaccatgcaaccaagccggaatgggggtcgtggggaaagtcggcgaaatccaatgcagctcggaggaaagcgccaggaccattaagaaagacggctgcatctggaacgcagacctagtaggcatcgaacttagggtcgacgacgcggtatgctacagtaaaatcacgtcggtagaagccgtggctaactactcagccattcccacaaccatcggcgggctacgatttgagcgctcgcacgactcgcaggttaaaatatcaggatcacccctggacataactgcaatgaggggctcattcagcgtaaactatagaggcctcagactaagcctctcagaaataacagcgacatgcaccggcgaggtcacaaacgtaagcggctgctacagttgtatgaccggagcaaaagtgagcatcaaactgcactcaagcaaaaatagcacggctcatgtaagatgcaagggagacgagaccgcgttcagcgtactcgaaggggtccatagctatacggtgagcctgagtttcgaccacgcagtagtagacgaacaatgccagctaaactgcggcggccacgaaagtcaagtgacactgaaaggaaacctcatctttctagatgttcccaaattcgtagacggttcgtacatgcaaacgtaccacagcacggtaccgaccggtgccaatatccctagtccaaccgattggctcaacgcactatttggaaacggattatcaaggtggatcctcggcgtgatgggagtcctcctcggcggcctagcgctctttttcatgataatgagcctgttcaagctcggcactaagcaagtcttccgaagcagaaccaagctcgcgtga

SEQ ID NO: 16548 - RNA, 3222 nt, synthetic construct
  misc_feature 1..3222: note = derived and/or modified CDS sequence (opt11) from SFTSV/FTLSV(YPQ5)__KF356532.1__GP
  source 1..3222: mol_type = other RNA
atgatgaaagttatttggttctcaagcctcatatgcttcgtaattcaatgtagcggtgacagcggaccaataatctgcgccggccccatccatagcaataagagcgcagacataccgcacctactaggctactcagagaaaatatgccaaatcgacaggctcatacacgtaagcagctggctccgcaaccactcgcaattccaaggatacgtgggccagcgcggagggcgctcacgagtctcatactaccccgccgaaaacagctacagcagatggtcgggactcctcagcccgtgcgacgcagactggctcggcatgctcgtagtgaaaaaggccaagggaagtgatatgatagtacccggcccatcatacaaaggaaaggtcttcttcgaacggccaaccttcgacggatacgtcggctggggctgcggcagcggcaagagccgaacggaaagcggtgaactctgctcatccgacagcggaaccagcagcggactcctaccgtcagaccgggtgctctggataggagacgtagcgtgccaacccatgacgccaataccagaagaaacgtttctcgaactcaagagctttagccagtcagagttccctgacatctgtaaaatagacggcatcgtattcaaccagtgcgaaggcgaatcactgccccagccctttgatgtagcctggatggacgtagggcactcccacaaaatcatcatgagagaacacaaaacaaaatgggtccaagagtcatcctcaaaagacttcgtctgctacaaagagggcaccggcccctgcagcgaaagcgaagagaaaacatgcaaaacctcaggctcctgcagaggcgacatgcaattctgtaaagttgcaggatgcgaacacggggaagaggcatcggaagcgaaatgccgctgcagcctagtgcacaaaccaggggaggtcgtagtctcgtacggcgggatgcgcgtacgaccaaaatgctacgggttctcccgcatgatggcaacgctcgaagtaaaccaacctgaacagagaatcggacaatgcaccggatgtcacctcgaatgcataaacggaggagtacggctaatcacactcacgagtgaactcaagagcgctacagtgtgcgccagtcatttctgcagcagcgccacatcaggcaagaaaagcaccgaaatccaattccacagcggctccctagtaggaaaaaccgcaatacacgtgaaaggcgcccttgtggacggaacagagttcacattcgaaggctcatgcatgttccccgatgggtgcgacgcagtcgattgcacattttgccgagagttcctcaaaaacccccaatgctaccccgccaaaaagtggctgttcatcatcatagtaatactcctgggctacgcagggcttatgctgttaacaaatgtactaaaagcaataggcatatggggatcctgggtaattgcaccagtcaaactcatcttcgccataatcaaaaagctaatgcgcacggtctcctgcctaatgggaaaactgatggacagagggcgacaagtaatacacgaagaaatcggggaaaatcgcgaaggcaaccaagacgacgtccgcatagaaatggcgcgcccgcgtcgggtgagacactggatgtattcaccggtgatcctaacaatactcgcaatcgggctagccgagagttgcgacgaaatggtccacgcagattccaagctagtctcatgtagacaaggtagtggaaacatgaaagagtgcgtcaccacagggagagcactactaccagcagtcaaccccggccaggaagcctgtctacacttcacggcaccagggagcccagactcgaaatgcctgaaaataaaagttaagcgcatcaacctaaagtgcaaaaagtccagcagctacttcgtacccgtagcccgataccgctgcacgagcgttaggcgatgcagatgggcgggagactgccagtcaggatgcccaccccacttcacaagcaacagcttctcgaacgattgggcaggcaaaatggaccgggccgggctaggattcagcggatgcagcgacgggtgcggcggtgcggcttgcggatgctttaacgccgccccaagttgtatcttttggagaaagtgggtcgaaaacccccacggcataatatggaaggtaagcccctgtgcagcctgggtcccgtcagcagtgattgagctgaccatgccatccggcgaagtacgcacattccaccccatgtccgggatcccaacacaggtcttcaagggcgtcagcgtaacatacctcggctcctacatggaggtaagcggcctgacagacctctgcgaaatagaggagctacggagcaagaaactcgcgctcgcgccctgcaaccaggcgggaatgggagtcgtaggaaaagtaggtgaaatccaatgcagcagcgaggaaagcgcccgcacgattaagaaagacgggtgcatatggaacgctgacctagtcggaatagagctccgcgtcgacgacgcggtctgctactcaaaaatcacctcagtagaggcagtcgctaactatagcgcgatccccacaacaataggcggactgagattcgaacgatcccacgatagccaggggaaaatctccggtagccccctcgacatcactgcgattcgcggatcgttctcagtgaactacagaggcctgcgactcagcctatcagaaataacagcaacgtgcactggcgaagtcaccaacgtaagcgggtgctacagctgcatgaccggagccaaagtctccattaaactacactcatcaaagaacagcaccgcacacgtccgatgcaagggcgacgagacagcgttcagcgtattggaaggtgtccactcatacacggtgtcactctcatttgaccacgctgtagtagacgaacagtgccaactgaattgcggcggacatgagtctcaggtaaccctgaagggcaacttaatcttcctagacgtcccgaaattcgttgacggatcatatatgcaaacataccacagcaccgtacccacaggggcaaacatcccgagtcccaccgactggctcaacgccctattcggcaacggcctgagcagatggatactcggggtcatgggagttctcctgggcggactcgccctcttcttcatgataatgtctctattcaagctaggcaccaaacaagtgttccgaagtagaacgaaactcgcctga

SEQ ID NO: 16549 - RNA, 3222 nt, synthetic construct
  misc_feature 1..3222: note = derived and/or modified CDS sequence (opt11) from SFTSV/FTLSV(YSC19)__KF356536.1__GP
  source 1..3222: mol_type = other RNA
atgatgaaggtaatctggtttagctccttagtctgcctggttatacaatgcagcggggactcgggacccatcatctgcgcaggaccaatccacagcaataaatccgccgccatccctcacttactggggtacagcgaaaagatatgtcaaatagacaggctaatacacgtatcctcctggctacgaaaccattcacaattccaaggctacgtgggccaacgcgggggccggagccaagtatcctactaccccgccgaaaactcctactcaaggtggagcggtctgctatcgccctgcgacgcagactggctgggaatgctggtcgtgaaaaaggcaaaaggcagcgacatgatagtaccagggccctcgtacaaaggcaaagtattcttcgagcgacccaccttcgacggatacgtagggtggggatgcgggtccggaaagtcccgaaccgaatcgggagaactgtgctcaagcgacagcggaacatcaagtggcctactcccatcagacagggtcctatggattggggacgtagcatgccaacccatgaccccgatacctgaagaaacattcctagaactcaagagcttcagccaaagcgagttccctgacatctgcaagatagatggaatagtcttcaaccaatgcgaaggcgaatcactcccccagcccttcgacgtggcttggatggacgtaggacactcacacaaaataataatgagggaacacaagacaaagtgggtgcaggaatcttcttcaaaagacttcgtctgttacaaagaaggcaccggaccgtgcagcgaatcggaagaaaaagcctgcaagacctccggttcctgcagaggagacatgcagttctgtaaagtagctggctgcgaacacggagaagaggcatcagaagcaaaatgccgctgctccctagtccacaaaccaggagaagtcgtggtcagctacgggggaatgcgtgtgcgaccaaagtgctacgggttttcccgcatgatggcaaccatggaagtcaacccacccgagcagaggattgggcaatgcaccgggtgccacctagaatgcataaacggaggcgtgcgcttaatcacactcaccagcgaactcaaatccgcaactgtttgcgcgtcacacttctgttcctccgcaacaagcggaaagaaaagtaccgaaatacacttccactcgggctcactggtaggcaagaccgccatccatgtgaaaggagcactggtggacggcacagaatttacattcgaaggcagctgtatgttccccgacgggtgtaacgcagtagactgcactttttgcagggagttcctcaaaaacccgcaatgctacccagccaagaaatggctctttatcataatagtcatactactcggatacgcgggccttatgcttctgactaatgtgttgaaagccataggagtctggggaagctgggtcatagcaccagtcaaacttatgttcgcaataatgaagaaactcatgcgaacggtatcatgcctcgtagggaaactaatggacagaggccgacaagtcatacacgaagaaataggcgagaacggtgaaggtaatcatgacgatgtgcgaatcgagatggcaagaccacgcagagtcaggcactggatgtatagcccagtgatactcaccatcctggcgatagggctggccgaaggctgcgacgagatggtacacgcggattccaagctagtctcgtgcagacaaggatccggaaacatgaaagaatgcgtgaccaccggaagggccttactaccgagcgtgaaccccggacaagaagcatgcctccacttcaccgcgccaggatcacctgacagcaaatgccttaaaataaaagtcaagagaatcaacctgaagtgtaaaaagtcgagctcctatttcgtacccatagcacgcaaccgatgcacaagcgtacgccgatgcagatgggcaggcgactgccagagcggctgcccacctcacttcacctccaacagctttagcgacgactgggcggggaaaatggaccgagcaggcctgggcttctctggatgctcagatggctgtggaggagccgcatgtgggtgcttcaacgcagccccctcctgcatcttctggagaaaatgggtcgaaaactcgcacggcatcatctggaaagtcagcccatgcgccgcatgggtaccctcagccgtcatcgaactcacgatgccatccggagaagtacgaacattccatcccatgtccggcataccaacccaagttttcaaaggcgtctcggtaacctacctgggctcagacatggaagtttcaggactaactgacctatgcgaaatcgaggaactgaaatcgaaaaagttggccctagccccctgcaaccaggccggaatgggggtggtcggtaaggtaggagaaatacaatgcagctccgaagaaagcgcaaggacgatcaaaaaggacggatgtatatggaacgccgaccttgtagggatagaactcagagtcgacgatgcagtctgctactcgaagatcacgtcagtcgaagcagtggcaaactactccgctatccctacaaccataggaggcctaagattcgaacgctcacatgacagccaaggaaaaatctcgggctcgcccctcgacatcaccgcgatccgtggatcattcagcgtcaactaccgcggcctacggctaagtctaagcgaaatcacggcaacctgcaccggcgaagtcacgaacgtcagtggatgctacagctgcatgaccggcgccaaggtgtcaataaaactacactccagcaaaaattctaccgcccacgtacgctgcaaaggagatgaaaccgcgttctcagtcctggaaggagtccacagctacacagtatctctgtcattcgaccacgccgtcgtggacgaacaatgtcagttaaactgcgggggccacgaatcccaagttacactaaaaggcaacctaatattcctagatgtacccaaattcgtcgacggctcgtacatgcaaacataccacagcacagttcccaccggagcaaacatacccagccccacagattggctaaatgcacttttcggaaacggcctgagcagatggatactcggagtaataggggtacttctgggaggcctcgccctcttctttttaatcatgttcctattcaaactgggtactaaacaggtattccgctcccgcacgaaactagcatga

SEQ ID NO: 16550 - RNA, 3222 nt, synthetic construct
  misc_feature 1..3222: note = derived and/or modified CDS sequence (opt11) from SFTSV/FTLSV(YSC3)__KF356535.1__GP
  source 1..3222: mol_type = other RNA
atgatgaaagtcatatggttctcatcgctcgtatgcctagtcatccagtgcagtggagactcgggacccatcatatgcgcgggacccatccactcaaacaaatccgcagcgataccgcacttactagggtattccgaaaagatctgccagatagaccggctcattcacgtctcatcctggctacgcaaccattcgcaattccaaggctacgtgggacagcgaggcggccgcagccaagtctcctactaccccgcagaaaacagctactcaaggtggagtggcttactctcaccttgcgacgcagattggctagggatgctagtcgtaaagaaagcaaaagggagcgacatgatcgtccccggcccatcctacaagggaaaggtcttcttcgaacggccaacgttcgacggatacgtaggctggggatgcggcagcggcaaaagcagaacagaaagcggggagctatgctctagcgacagcggaacttccagcggactcctgccatcggacagagtactgtggataggcgatgttgcatgccaaccgatgacaccgatcccggaggaaacctttctggagctcaagagcttcagccaaagcgagttcccagatatatgcaaaatagacgggatcgtcttcaaccagtgcgaaggcgaatcccttccacaaccattcgacgtggcctggatggacgtcggacacagccacaaaataatcatgcgggaacacaaaacaaaatgggtccaggaatcaagctcaaaagatttcgtatgctacaaagagggcaccggcccatgctcagaatcggaggagaaaacgtgcaaaacatcaggaagctgccggggagacatgcaattctgcaaagtagccggatgtgaacacggagaagaagcgtcagaagcgaaatgtagatgtagtctcgtccacaaaccgggtgaagtcgtcgtatcctatgggggcatgcgagtgcgtccaaaatgctacgggttcagcaggatgatggcgaccctagaagtaaaccagcccgagcaaaggatcgggcaatgcaccggatgccacctagagtgtatcaacggaggcgtccgcttgataacactcacaagcgaacttaaaagcgcgaccgtatgcgcaagccacttctgtagctccgcaacatccgggaaaaagagcacagaaatacaattccacagcggcagcctagtcggcaagacagcaatccatgtcaaaggtgcgctagtagacggcacagaatttacgttcgaaggctcgtgtatgttcccagacgggtgcgacgccgtggactgcaccttctgcagagagttcctcaagaacccgcagtgctaccccgcgaagaaatggctattcatcatcatcgtcatactcctcggctacgccggtctaatgctgttaacgaacgtcctgaaagcaataggcatctggggaagctgggttatagccccggtaaaactaatattcgcaatcatcaagaagctaatgcgaacagtctcgtgcctcatgggaaagctcatggatcgaggtcgccaggtcatccacgaggagataggcgaaaacagagaagggaaccaagacgacgttcgaatagagatggcaaggccacgcaggatacggcactggatgtacagccccgtaatattgacgatactcgccatcggcctagcggaatcgtgcgacgagatggtacacgcggacagcaagttggtgtcgtgcagacaaggaagtggaaacatgaaggagtgtgtgaccacaggcagggcattactgccagcagtcaacccgggtcaagaagcatgcctgcactttactgccccaggctcaccagacagcaaatgcctaaagataaaagtcaaacgaattaacctcaaatgcaagaaaagttcatcctacttcgtgcccgacgcccggagccgatgcaccagcgtgcgccggtgcagatgggctggcgactgccaatcagggtgtcccccacacttcacaagcaactccttctccgacgactgggccggaaaaatggaccgagcaggccttggattctcagggtgcagcgacggatgcggaggagccgcatgcggatgcttcaacgcagccccatcatgcatcttctggcggaaatgggtcgaaaacccccacggtataatatggaaagtaagcccctgcgccgcatgggtaccatcagcggtaatcgaactcacaatgccaagcggagaagtacgaacattccaccccatgagcggaatccccacccaggtattcaaaggagtatccgttacctaccttgggtcagacatggaagtcagtggcctcacagacctatgcgaaatagaagaactgaaatccaagaaattagcattagcgccctgcaaccaagcaggcatgggagtagtcggcaaagtgggtgaaatacaatgcagttccgaagaatcagcgcgaaccatcaagaaagacggatgcatttggaacgcggacctcgtcgggatcgagctcagagtagatgacgcggtatgctacagcaaaataacaagcgtagaagccgtcgccaactactcggccatccccacgacaatcggcggcttgagattcgagaggtcgtatgacagccaaggcaaaatctcagggagcccgcttgacatcacagcgatcagaggctccttttccgtcaactacagaggtctgcgactgagcttatcagagataacagccacatgcacaggcgaagtcacaaatgtaagcgggtgctacagctgcatgaccggagcaaaagtaagcattaaactgcactcaagtaagaactcaaccgcgcacgtccgatgcaagggagacgaaaccgcattcagcgtcctggaaggagtacacagttacaccgtatcactcagcttcgaccacgcggtagtcgacgaacaatgccaactcaattgtggagggcacgaatcgcaagtgacattaaaggggaaccttatcttcttggacgtaccaaaattcgttgacggatcgtacatgcaaacatatcacagcacggttccaacaggcgccaatatcccgtcaccaacagactggctaaacgcactcttcggaaatggcctaagccgatggatcctgggagtcataggcgtgctcctgggaggcctagccctcttctttatgataatgtcattattcaaactagggaccaaacaggtcttcaggagcaggaccaagctggcatga

SEQ ID NO: 16551 - RNA, 3222 nt, synthetic construct
  misc_feature 1..3222: note = derived and/or modified CDS sequence (opt11) from SFTSV/FTLSV(YSH39)__KF356529.1__GP
  source 1..3222: mol_type = other RNA
atgatgaaagtcatttggtttagcagcttaatatgcttcgtcatccaatgcagcggcgacagtggtcccatcatctgcgcaggcccaatccacagcaacaaaagcgcagacatcccacatctcctcgggtactcagagaaaatctgccagatcgaccgtctaatccacgtgtcctcatggttaagaaaccattcgcaattccaaggctacgtcggacaaagaggcgggcgaagccaggtcagctactaccccgccgaaaactcctactcaagatggtcgggcctcctaagtccctgcgacgcggactggctgggcatgctagttgtaaagaaagcgaagggatccgacatgattgtaccaggaccctcctacaaaggcaaggtattcttcgaacgaccaacgttcgatggatacgtcggatggggatgtggctccggtaaatcccgaacggaaagcggagaactatgttcaagcgacagcggcacgagctcaggcctcctacccagcgacagagtactttggattggagacgtcgcttgccaacccatgacgcccatcccagaggagaccttcatggaactcaagagtttcagccagagcgagttccccgacatctgcaaaatcgacggcatcgtcttcaaccaatgcgaaggggagagcctaccccaacccttcgatgtcgcctggatggacgtcggtcactcccacaaaatcataatgcgagaacacaaaacaaaatgggtacaagagtcaagctcaaaagacttcgtgtgctataaagaaggtacagggccctgttcagaaagcgaagaaaagacctgcaagaccagtggatcatgccgaggcgacatgcagttctgcaaagtcgcaggctgcgaacacggagaagaagcctcagaagcaaaatgccgctgttcccttgtccacaaaccaggagaagtagtcgttagctacggaggcatgcgaatacgtcctaaatgctatggcttctctagaatgatggccactctagaagtaaaccaaccagaacagcgaatcggacagtgcacaggttgtcacctagaatgcatcaatggcggcgttcggttgataaccctcacctccgaattaaaaagcgcgaccgtctgcgctagccacttctgctcctccgccacatcaggcaagaaatcaacagaaatccaattccactcgggatccctcgtgggtaaaaccgccatccacgtaaaaggcgcccttgtagacggaaccgagttcacattcgaaggatcctgcatgttcccggacggctgcgacgcagtcgactgcacattctgcagagaatttcttaaaaacccccaatgctaccccgccaagaaatggctattcatcatcatcgtgatcctactcggccacgcaggattaatgctcctcaccaacgtcttaaaagcgatcggaatctggggcagctgggtcatcgcccccgtcaaactaatattcgcaataataaagaaactcatgcgcaccgtctcatgcctcatgggaaaactaatggaccgcggccgacaagtgatccacgaggaaatcggcgaaaatcgggaaggaaaccaggacgacgtcagaatcgaaatggccaggccaagacgagtccgccactggatgtactctcccgtgatactcacaatcctagcaataggactcgcagaaagttgcgacgaaatggtccacgcggactccaaactggtctcatgtagacaaggctctggaaacatgaaagaatgcgtgaccaccggaagggccctactcccggccgtcaacccaggacaggaagcctgcctccattttactgcccccggaagtccagactcgaaatgcctaaaaattaaagtaaaaagaatcaacctgaaatgcaaaaagagctcctcctacttcgtacccgacgcccgaagtagatgcacgagcgtcaggcgctgccggtgggcaggagactgtcaatcaggctgtcccccacacttcacatccaactccttctcagacgactgggccggaaaaatggatagagcagggctcggattttcaggctgcagcgacggctgcggaggcgcagcctgcggatgcttcaacgcagccccatcctgcatcttttggcgaaaatgggtagaaaacccgcacgggattatatggaaagtatcaccatgcgccgcgtgggtgccatcagcggtgattgaactcacaatgccctctggtgaagtacgcacattccacccaatgagcggcatacccacccaagtcttcaaaggcgtatccgtaacatacctcgggtcggatatggaagtaagcggccttaccgacctttgcgaaatagaagaactaaaaagcaaaaagctagccctcgcaccatgcaaccaagccgggatgggagtcgtaggcaaagtcggggaaattcaatgttcttcagaggaatccgcacgaaccatcaagaaagacggttgcatctggaacgccgacctcgtcggcatagaactccgagtcgacgacgccgtatgctactccaaaataacatccgtcgaggccgtcgcgaactattcggctatcccgacaacgatcggcgggctccgcttcgaacgatcccacgactcccagggaaaaatcagcggcagcccgctagacataaccgcaatccgcggctccttctcagtcaattatcgaggactgcgcctaagcctaagcgaaataacagcgacctgcaccggcgaagttacaaacgtgtccggctgctacagctgtatgacaggcgccaaagtatcgataaaactacactccagtaaaaacagtacagcccacgtcagatgcaaaggagacgaaacggccttctcagtcctagaaggtgtccacagctacaccgtatccctgtccttcgaccacgccgtcgttgacgaacaatgtcagctaaactgcgggggacatgaaagccaggtcacgttaaaaggtaacctcatattcctcgatgtcccgaaattcgtagacggcagctacatgcaaacataccactccacagtaccaaccggcgcgaatatccccagcccaaccgattggctcaacgccctatttggcaacggcctatccagatggatactcggcgtcatcggcgtactccttggaggtctcgccctcttcttcatgataatgtcccttttcaaactcggcaccaaacaggtgtttcgatcacgaaccaagctagcgtaa

SEQ ID NO: 16552 - RNA, 3222 nt, synthetic construct
  misc_feature 1..3222: note = derived and/or modified CDS sequence (opt11) from SFTSV/FTLSV(YSHX002)__KF356540.1__GP
  source 1..3222: mol_type = other RNA
atgatgaaagtaatctggttcagctcactaatctgcttagtcattcaatgctcaggcgactcagggccgattatctgcgcgggaccaatccacagtaacaagtccgcaggcatcccccacttgctagggtacagcgagaaaatctgtcaaatcgacagactaatccacgtgtcctcgtggctcagaaaccactcacaattccagggatacgtaggacaacgaggaggccgctcgcaggtatcgtactacccagcggaaaacagctacagtcgatggaacggcctgctcagcccatgcgacgccgactggctgggaatgctggtcgtaaagaaagcgaaagaatccgacatgatcgtccctggccccagctacaaaggaaaagtcttcttcgaaaggccaacattcgacggatacgtggggtggggctgcggcagcggaaaaagcagaaccgaatcaggcgaactgtgctccagtgacagcggtaccagctccggtctactccccagtgacagggtactctggataggcgacgtggcgtgtcaaccaatgaccccgatccccgaagagacattcctggaactcaaatccttctcccaaagcgagttccctgacatctgcaaaatagacggcatcgtattcaaccaatgcgaaggcgaatcactaccacagccctttgacgtggcctggatggacgtcggccactcacacaaaataatcatgcgcgaacacaaaacaaaatgggtacaggaatcaagctccaaagacttcgtctgctacaaagaaggaaccggaccatgcagcgaatcggaagaaaaggcctgtaaaacctccggctcatgtagaggagacatgcaattctgcaaagtcgccggctgtgagcacggcgaagaggccagcgaagcaaaatgccgatgctcgctagtacacaaaccgggggaagtagtggtatcatatggcgggatgcgagtacgccctaaatgctacgggttctcccgcatgatggcgaccctcgaagtgaatccacccgaacaaagaataggacaatgcaccggatgccacctcgaatgcatcaacgggggagtaagactgataacactcacaagcgagctacggagcgcgacagtttgcgcatcccacttctgctcctcagcaacaagcggaaagaaaagcacagagatacacttccattccggatcgctcgtgggaaaaactgccatccacgtcaaaggcgcactcgtagacggcacagaatttacattcgaaggctcctgcatgttcccagacggctgtgatgcagtggattgtacgttctgccgagagttcctgaaaaacccgcagtgctacccggccaagaaatggctattcataatcatagtcatcctgctgggatatgcaggattaatgctggtcacgaacgtgctcaaggcaattggcgtatggggtagctgggtaatcgccccggtcaaactcatgttcgccattatcaagaaactaatgcgcacggtaagttgcctagtcggcaaactcatggaccgaggccgccaagtcatacacgaagagatcggcgaaaatggagaaggaaatcaggatgacgtaaggatcgagatggcacggccacgccgagtcagacactggatgtactcgcctgtcatactcacaatactagcaatagggctagccgaaggatgcgacgagatggtacacgccgactcgaaacttgtcagctgccgccagggctccggtaacatgaaagaatgtatcaccacaggacgcgccctcttacccgcagtcaacccaggacaagaagcctgcctacacttcacagcccccggcagcccagacagcaaatgcctaaagattaaggtaaagcgaatcaacctcaagtgcaaaaagagcagtagctactttgtccccgacgcgagaagccgatgcacgtccgtacgaagatgtaggtgggcaggagactgccaaagcggctgcccgccacacttcacgagtaacagcttcagcgacgactgggcgggcaaaatggaccgagccggactcggattctcaggctgcagcgacggatgcggcggtgccgcctgcggatgcttcaacgcagccccgtcctgtatcttctggcggaagtgggtcgaaaacccgcacggtatcatatggaaagtaagcccctgcgcggcatgggtcccttccgccgtgatagaactcaccatgccctccggagaagtacgcacatttcacccaatgagcggcattcccacccaagtattcaagggagtcagcgtaacatacctcgggtcagacatggaagtgtccggactaacagacctatgcgaaattgaagaactcaaatcgaagaaactcgccctagccccatgcaaccaagcagggatgggggtcgtgggaaaggtcggcgaaaaacaatgtagcagcgaagagagcgcacggacaatcaaaaaggacggatgcatatggaacgcagacctagttgggatcgaactgagagtggacgacgcggtatgctactccaagataacatcagttgaagcagtggcaaactattcagccatcccaacaacaatcggaggactcagattcgagcgatcccacgacagccaaggcaagatcagcgggagcccattagacatcaccgccatccgaggctcattctccgtcaattaccgaggcctacgcctcagtctctccgagatcacagcaacctgcaccggagaggtcacgaacgtcagcggctgttacagctgcatgacgggcgccaaagtaagcatcaagttacactcgagcaaaaactcaacagcccacgtaagatgcaagggcgatgagaccgccttctccgtactagaaggagtccacagctacatagtgtccctcagctttgaccacgctgtagtcgacgaacaatgccaactaaactgcgggggccacgaaagccaagtaacactaaaaggaaacctaatttttctagatgtccccaagttcgtagacggttcatatatgcaaacataccactccacggtcccgactggagcgaatatcccgtccccaacggactggctaaacgccctattcggcaatggcctgtccaggtggatactgggtgtcataggcgtcctcctgggagggctcgcactcttcttcctcatcatgttcctgctcaaactaggcaccaaacaagtcttccgctcacgcacaaaactggcatga

SEQ ID NO: 16553 - RNA, 3222 nt, synthetic construct
  misc_feature 1..3222: note = derived and/or modified CDS sequence (opt11) from SFTSV/FTLSV(YXX2)__KF356534.1__GP
  source 1..3222: mol_type = other RNA
atgatgaaagtcatctggttcagctccctaatctgtttagtaatacaatgcggaggcgacacaggcccaataatctgcgcggggccaatacacagcaacaaaagtgccgacatcccccacttgctaggatattcggagaaaatatgtcaaatagacaggctcatccacgtaagctcatggttaagaaatcactcgcaattccaaggatacgtaggccagagagggggtagaagtcaagtctcctactaccccgcggaaaactcctacagccgctggagtggattgttgtccccatgtgacgcggactggctaggaatgcttgtagtgaagaaagccaaaggctcagacatgatcgtccccgggcccagctacaaaggaaaagtcttctttgaaagaccgacattcgacgggtacgtcggctgggggtgcggcagcggaaaaagcaggacagaaagcggggaactgtgctcgagtgacagtggaacctcaagcgggctcttgccctccgaccgcgtattgtggataggcgatgtagcctgccagccaatgaccccgatcccggaagaaacatttctcgaactaaaatcctttagccaaagcgagttccccgacatctgcaagatagatgggatcgtcttcaaccaatgcgagggagaaagtctgccccagcccttcgacgtagcctggatggacgtaggccactcccacaagatcatcatgagagaacacaagaccaaatgggtgcaagagtcaagcagcaaagacttcgtgtgctacaaagagggaacgggaccatgctccgaatcagaagagaaaacctgcaaaaccagtggctcttgcagaggagacatgcagttctgtaaagtcgccgggtgcgaacatggcgaagaggcttcagaagcgaaatgtcgatgctcactggtacataaacccggagaagtcgtcgtctcctacggcggaatgagggttcgccccaaatgctacggcttctcgagaatgatggccaccttggaagtaagccaacccgaacaaaggattggacaatgcaccggttgccacctggaatgcatcaacggaggagtacgcctgatcacactgacatcagagctcaagtccgctaccgtctgtgcaagccatttctgttcaagtgccacctctggcaaaaagagcacagagattcaattccactcggggagcctcgtgggcaaaactgcgatccacgtcaagggagctctagtagacgggacagagttcacattcgaaggctcgtgcatgttcccagacggatgcgatgcagtggactgtacattctgccgagagttcctgaaaaacccccaatgctacccagcgaagaaatggctatttatcataatagtaatactactaggctacgcgggtctcatgctgctcaccaacgtactaaaagccataggagtctggggctcatgggtcatagccccagtcaaactcgtattcgcgataataaagaaactgatgcgagcagtatcctgcctgatggggaaactaatggatcgaggacgacaggtaatacatgaagaaattggagaaaaccgggaagggaaccaagacgacgtcaggatcgaaatggcgaggccgagacgagtacggcactggatgtactcaccggtaatactcacgatacttgctatcgggctggccgaaggctgcgacgaaatggtgcacgccgactccaaactcgtcagctgcagacaaggctcaggcaacatgaaagaatgcgtaaccacaggcagagccctactaccagcagtaaaccccggacaagaagcgtgtctccacttcacagcgcctggatcccccgactcgaaatgcctaaagatcaaggtaaagagaataaacttgaaatgcaaaaagagctccagttatttcgtccccgacgccagaagcagatgcacatcagtacgccgctgccgatgggccggtgactgccaatcaggatgcccgccacattttacaagcaatagcttttcagacgactgggcagggaaaatggacagagcaggactaggattctcgggctgttcagacggctgcggcggagcagcgtgcgggtgcttcaacgcagcacccagctgcatcttctggagaaaatgggttgaaaacccacacggcataatctggaaagtaagcccctgcgccgcatgggtgcccagcgccgttatagaactaaccatgccgagcggagaagttcgaacgttccacccaatgtccgggatcccaacacaggtcttcaaaggagtcagcgtaacgtaccttggctctgatatggaagtaagcggcctaaccgacctttgcgagatcgaggaactaaaaagcaagaaactagcgctagcaccctgcaatcaagcaggaatgggggtcgtgggaaaggtcggagaaatacaatgcagctcagaagaaagcgcccggaccatcaagaaggatggctgcatctggaacgcggacctagttggaatcgaactaagggtagatgacgcagtttgctactcaaagataaccagtgtcgaagcagtggccaactactccgccatccccacaaccataggaggtctacggttcgaacggtcacacgacagccagggtaagatctcaggctcgccactagacattacggcgatcaggggatccttcagcgtgaactatcgaggcttacggttgagcctgagcgaaatcacggcaacatgcacgggggaagtcaccaatgtaagtggatgctacagctgcatgacgggcgcgaaggtatccatcaaattacacagcagcaagaactcaaccgcccacgtacgctgcaaaggcgacgaaacggccttctcggtgctggaaggtgttcacagctactccgttagcctcagcttcgattacgcagtggtcgatgaacagtgccaactcaactgcggaggacacgaatcgcaagtaaccctaagggggaacttaatatttctggatgtaccaaaattcgtagacggaagctacatgcagacgtaccacagtaccgtgccaacaggagccaacatccccagcccaaccgactggcttaacgccctattcggcaacgggctgagtcggtggatactcggagtcatcggcgtgctcctcggaggcctggccctgttcttcctaataatgagcctgttcaagctcggaacgaaacaaatcttccgcagcaggaccaagctggcataa

SEQ ID NO: 16554 - RNA, 3222 nt, synthetic construct
  misc_feature 1..3222: note = derived and/or modified CDS sequence (opt11) from SFTSV/Huaiyangshan virus(2010-FQM)__HQ419236.1__GP
  source 1..3222: mol_type = other RNA
atgatgaaagtcatctggtttagcagcctaatatgcttggtcatacaatgcggaggcgacaccggccccataatttgcgccggaccaatacattccaacaaatcagcggacatcccacacctacttggctacagcgagaaaatatgccaaatagacaggctcatacacgtcagttcctggttacgaaaccatagtcaatttcaaggatacgtggggcaacgcggtggtagaagtcaggtctcgtactacccagcggaaaacagctactcacgctggtcaggcctattaagtccatgcgacgcagactggctaggaatgctagtggtgaaaaaggccaagggaagcgacatgatcgtaccagggccgagctacaaaggaaaagtcttcttcgaaagaccaaccttcgacggatacgtgggttggggctgcggctcgggcaaaagccgcactgagtccggggaactgtgctccagcgacagcgggacatcgagtggcctcttgccatcagaccgcgtactatggataggagacgtagcatgtcagcccatgacacccataccagaagagaccttcctcgagctaaagagcttctcacaaagcgagtttcccgacatatgcaaaatcgacggaatcgtgttcaatcagtgtgagggagagagcctaccgcaacccttcgatgtagcttggatggacgtcggccactcacataaaatcataatgagggaacacaaaacgaaatgggtccaggaaagcagctccaaagacttcgtgtgctacaaagaaggcacaggaccgtgttcagagagcgaggaaaaagcctgcaaagcatcgggttcatgcaggggcgatatgcaattctgtaaagtggccggatgcgaacacggcgaagaagcgtcagaagctaaatgcagatgttcacttgttcacaaaccaggcgaggtagtagtgtcgtacggcggaatgcgtgtccgcccaaagtgttacggctttagccggatgatggccaccctcgaagtaagccagcccgaacaacgaataggacagtgcaccggctgccacctcgaatgcataaacggaggagtcaggctcataacactcacgagcgagctaaagagcgcgaccgtatgcgcaagccacttctgcagctccgccacaagcgggaagaaatcgaccgagatccaatttcactcgggcagtctcgtcggcaagacagcaatccacgtaaaaggagcgctagtagacggaaccgagttcacgttcgaaggctcatgcatgttcccagacggctgcgacgcagtagactgcaccttttgcagggagtttctgaagaacccccagtgttacccagccaagaagtggctctttatcattatagtaatcctgctcgggtacgcgggattaatgctcctaacgaacgtactcaaggccataggcgtctggggaagctgggtcatagccccggtgaagctcgtgttcgcaattattaaaaagctgatgcgggccgtatcgtgcttaatgggaaaactgatggatcggggacgccaagtaatacacgaagagataggagagaacagggaggggaatcaagacgacgtccgaatcgagatggcgcgccccagacgtgttcggcactggatgtattcaccggtcatactcacgatactagcaatcggactagccgagggctgcgacgagatggtccacgccgattccaagctagtgtcatgcaggcaaggaagtggcaacatgaaagaatgcgtcaccacaggcagggccctgctcccagcggtcaaccccggacaagaagcatgcctgcacttcaccgcaccagggagcccagactcaaaatgcctcaaaataaaagtaaagcgcatcaacctgaagtgcaagaaaagcagcagttacttcgtaccagacgcgaggagccggtgcaccagcgtgcgaagatgccggtgggccggcgactgccaaagcggatgcccgccccatttcacgagcaacagtttcagcgacgactgggccggcaaaatggaccgagcaggactaggattcagtggctgcagtgacggctgcggtggagccgcatgcggatgctttaacgcagcacccagctgtatattttggcgaaaatgggtcgagaatccgcatggcatcatatggaaagtatcaccctgcgccgcatgggtacccagcgcagtaatagaactgaccatgccatcaggagaagtgaggacattccaccccatgagtggcatcccaacacaagtattcaaaggagtctcagtcacctacctgggctctgacatggaagtcagcggtctcacggacctgtgcgaaatcgaggaattaaagagtaaaaagctagcgctcgcgccctgcaaccaagccgggatgggcgtcgttggcaaagtcggggaaatccaatgcagtagcgaagagagcgcgcgcacaatcaagaaagacggatgcatttggaacgcagaccttgtcggaatcgagctccgagtcgacgacgccgtctgctactccaaaataacctccgtcgaagccgtcgcaaattattccgcaataccaacgacgatcggcggactaaggttcgaacgatcgcacgacagccagggcaagatctcgggaagccccctcgacataacggcgatcagaggttcgttctcagtaaactatcggggcttacgcttgagtctgtccgaaattaccgcaacgtgcacaggagaggtcacgaacgtgtccgggtgctacagctgcatgacaggcgccaaagtcagcatcaaactccactcgtccaaaaactcaaccgcacatgtacgatgtaaaggcgacgaaacagcattcagcgtgctagagggggtccactcttactcggtaagcctcagcttcgaccacgctgtcgtagacgaacaatgccaattaaactgcggaggacacgaatcgcaagtgactttaagaggcaacttaatcttcctcgacgtcccaaaattcgtagacggctcatacatgcaaacctaccatagcacagttccaaccggggcaaacatcccaagcccgacagactggctaaacgctctcttcggtaacggcctaagccgatggatactaggcgtcataggagtattattgggaggacttgccctcttcttcctgatcatgttcctcttcaaactcgggaccaaacaaatattccgatcccggacaaagctagcatag

SEQ ID NO: 16555 - RNA, 3222 nt, synthetic construct
  misc_feature 1..3222: note = derived and/or modified CDS sequence (opt11) from SFTSV/Huaiyangshan virus(2010-LZR)__HQ419237.1__GP
  source 1..3222: mol_type = other RNA
atgatgaaggtaatatggttcagcagcctcatctgcctcgtcatccagtgcggcggagacactggcccaataatatgcgcggggcccatccattcaaacaagagcgccgacatcccccacctactggggtactctgagaaaatctgtcaaatcgaccgactcatccacgtaagcagctggctccgaaaccactcccaattccaaggctacgtgggccaacgcggcggcaggagccaggtatcctactaccccgcggaaaactcctactccaggtggtccggcctcctctccccctgcgacgcagactggctcggcatgctcgtagtgaagaaagccaaaggatcagacatgatcgtcccgggaccatcttacaaaggcaaagtatttttcgaacggccaacattcgatgggtacgtaggctggggctgcggatcaggcaaatctcgaaccgagagcggcgagctttgctccagcgactccggaacatcatcaggactcctcccctccgaccgagtactctggatcggcgacgtagcatgccaacccatgacccctatcccagaagagactttcctcgagctcaaatctttctcccaaagcgagttcccggacatctgcaaaatcgacggcatcgtctttaatcagtgcgaaggagaatccctaccccaaccattcgacgtcgcctggatggatgtcgggcattcacacaaaatcatcatgcgggaacacaagaccaaatgggtacaagaatcgtcctcaaaagactttgtctgctacaaagaaggcaccggtccttgcagcgaaagcgaagagaaaacttgcaagacttcgggatcgtgccgaggcgacatgcaattttgtaaagtagcaggatgcgaacacggagaagaagcaagcgaagccaaatgccgctgttccctggtccataaaccaggcgaagtcgtcgtcagctacggaggaatgcgcgtccgtccaaagtgctacggcttctcccgcatgatggcaaccctcgaagtgagccaacccgaacaacgaataggacaatgcacaggttgccacctagagtgtataaatggtggcgtccgcttgatcactctaacgagtgaactaaaatcggccaccgtctgcgcatcccacttctgctccagcgccaccagcgggaagaaatccacagaaatacaattccactccgggtcgctcgttggaaaaacagcaattcacgtcaaaggggcactcgtggacggaaccgagttcacattcgagggctcctgcatgttcccagacggttgcgacgccgtagactgcaccttctgccgagagttcctaaagaacccccaatgttacccggcaaagaaatggctctttataatcatcgtaatactcctaggctacgccggtctgatgttactaaccaacgtactaaaagccattggggtgtggggcagctgggtcatagcaccggtaaagctagtattcgcaataatcaagaaacttatgcgagcggtctcgtgcctcatgggtaaattaatggacagaggaagacaagtgatccacgaagaaataggcgaaaaccgagaaggaaatcaggacgacgtcagaattgaaatggcccggccccgccgcgtaaggcactggatgtactcccctgtcatccttactatcctagctataggactcgcagagggatgtgacgaaatggtccacgcagactcgaaactcgtgtcatgcagacaaggctctggcaacatgaaagaatgcgttacaaccggccgcgcactcctacccgccgtcaatccgggccaagaagcatgcctgcacttcacagcccccgggagccccgactcgaaatgcctaaaaatcaaagtcaaacgcattaacctcaaatgcaagaaatccagcagctacttcgtgccggacgcacgttcacgatgcacctcagtccgacgatgccgatgggccggggactgccagtccggatgcccaccccacttcacaagtaactctttcagcgatgactgggcgggcaaaatggacagagccggactgggattctcaggctgctcggacgggtgcggcggcgcagcatgcggatgtttcaacgccgcaccctcatgcatcttctggcgcaaatgggtcgaaaacccccacggaatcatctggaaagtatcgccctgcgcagcgtggatcccatccgcggttatagaactaaccatgccaagcggcgaagtcagaaccttccatccgatgtccggcatcccaacgcaggtctttaaaggagtatcagtaacgtaccttggcagtgacatggaggtaagcggactaaccgacttatgcgaaatagaagaactcaaatccaagaaactcgcactcgcaccctgcaaccaagcaggaatgggagtcgtcggcaaagtgggcgaaatccaatgttccagcgaagaatccgcacgcaccatcaagaaagacggctgtatctggaacgccgaccttgtcggaatcgagcttagggtcgacgacgcagtctgctattcgaaaatcacatccgtcgaagcagtcgccaactacagcgccatcccaactacaataggaggcctgaggttcgaacgcagccacgacagccagggaaaaatcagcggcagccccctcgacatcaccgccatcaggggctccttctcagtaaactaccgcggcctcagattaagcctatcagaaataaccgcaacctgcacgggagaagtcacgaacgtgagcggctgttatagctgcatgacaggcgccaaagtcagcataaaactacactccagcaaaaacagcaccgcacacgtccgctgcaaaggtgatgagaccgccttcagtgtcctcgagggcgtacactcatactcagtgtcactgagcttcgaccacgcggtcgtcgatgaacagtgccaactaaactgcggcggccatgaatcgcaagtcacgctgagaggcaacctaatcttcctagacgttccgaaattcgtagacggctcctatatgcaaacctaccactcgacagtcccaaccggggccaatataccatcacccaccgactggctcaatgcgctattcggcaacggcctatccaggtggatactaggcgtaatcggcgtactcctaggaggcttagcactctttttcctgataatgtccctattcaaactaggaaccaaacaaatcttcagaagccgaacaaaactagcatga

SEQ ID NO: 16556 - RNA, 3222 nt, synthetic construct
  misc_feature 1..3222: note = derived and/or modified CDS sequence (opt11) from SFTSV/Huaiyangshan virus(2010-T112)__HQ419238.1__GP
  source 1..3222: mol_type = other RNA
atgatgaaggtcatatggttcagctccctaatatgctttgtaatacaatgctccggagacagtggaccgatcatatgcgcagggcccatacactcaaacaaatcagctgacataccccacctcttgggatactcagaaaagatctgccaaatagacagactcatccacgtcagttcctggctacgcaatcactcccaattccaagggtacgtagggcagcgcgggggacgaagccaagtatcgtactacccagcagaaaacagctactcacgatggtcaggcctgctctccccatgcgacgcagactggctcggcatgctcgtagtcaaaaaggcaaaaggcagcgacatgatagtccccggaccttcctacaaaggcaaggtattcttcgaaagaccaaccttcgacggctacgtagggtggggatgcggatcgggcaagagccgcacagaaagtggcgaactttgctcaagcgacagcggcacctcatcaggcctgctaccttcagacagagtcctatggataggcgacgtagcatgccagccaatgacaccaatacccgaggagaccttcctcgaactgaaatcctttagccaaagtgagttcccggacatctgcaagatagacggaatcgtattcaaccaatgcgaaggcgaaagcctgccccaaccattcgacgtcgcctggatggacgtcggccactcccacaaaatcatcatgagggaacacaaaacgaaatgggtacaggagtcaagcagcaaagacttcgtctgttacaaggaggggacaggcccctgctcagaatccgaggagaaaacatgcaagaccagcggcagctgcagaggcgatatgcagttctgtaaagtagcaggatgcgaacacggcgaagaagccagcgaagcaaaatgccgatgcagcctggtccacaagcccggcgaagtagtggtctcctacggcggcatgagagtcagacccaaatgctacggattctcgcggatgatggctacactggaagtaaaccaaccggtgcaacgcatcgggcaatgcacaggttgtcacctagaatgcattaacggcggggtacgccttatcaccctaaccagcgaactaaaaagcgctaccgtctgtgccagccatttctgctcctccgctacctctggcaagaaaagtaccgagatacaattccacagcggctcgctagtaggcaaaaccgccatccacgttaagggagccctagtagacggaaccgaatttacattcgaaggatcatgcatgttcccggacggctgcgacgcggtcgactgcacattctgtcgggagttcctgaaaaacccacaatgctatccagctaagaaatggttgttcataataatagtcatcctcctaggatacgcaggactcatgctcctcacaaacgtcttaaaagcaatcgggatatggggatcctgggtaattgccccagtgaaactcattttcgcaataatcaagaaactaatgcgcacagtatcatgcctcatgggaaaacttatggaccgagggcgccaagtcatacacgaggagattggcgaaaaccgcgagggtaaccaagacgacgtacgaatagaaatggcgcgcccccgcagagtcagacactggatgtacgccccagtcatccttacaatccttgccatgggactggccgagagctgcgacgaaatggtccacgcggacagtaaactcgtaagctgcaggcaagggtccggcaacatgaaagaatgcgtcaccaccggtagggccctcctgccggcagtgaaccccgggcaggaggcctgccttcacttcaccgccccaggatcaccggactcaaaatgcctgaaaatcaaagtgaaacgcataaacctcaaatgcaagaaaagctcctcgtacttcgtacccgacgcccgcagccgatgcaccagtgtaaggcgctgccgatgggcgggagactgtcaatcaggctgcccaccacacttcaccagcaacagcttcagcgacgactgggcaggcaaaatggaccgagcaggactcggattctcaggctgcagcgacggatgcggcggcgccgcatgcggctgcttcaacgccgcaccgagctgcatcttctggagaaaatgggtcgaaaacccgcacggaatcatatggaaagtcagcccttgcgtagcatgggtgccctcggccgtgatcgaactaacaatgccgtcaggagaagtccgaacattccaccccatgagcggaatacctactcaagtgttcaaaggagtctcagtcacgtacctggggagcgacatggaagtcagcggcctcaccgacctctgcgaaatcgaagaacttaaaagcaagaaacttgccctcgcaccctgtaaccaggccggaatgggcgttgtaggcaaagttggggaaatccaatgctccagcgaagaatccgcccgcaccatcaagaaagatggatgcatctggaacgccgacctagtaggaatagaacttcgcgtcgacgacgcggtttgctattctaaaataacatccgtcgaggccgtggccaattacagcgccatcccaaccaccatcggcggcctacgatttgaacgtagccacgactcacagggcaaaatatccggctcccccttggacatcaccgcgatccggggatcatttagcgtaaactaccgaggcctgcgcctatccctaagcgaaatcacagcaacatgcaccggcgaagtcacaaacgtatcgggctgttacagttgcatgacgggcgcaaaagtctccatcaaactccacagtagcaaaaactcaacagcgcacgtacgctgcaaaggagacgagaccgcgttctcggtcctagagggtgtccactcctacacagtgtccctatccttcgaccacgcagtcgtcgacgagcagtgccagctcaactgcggaggacacgagagccaagtaaccctaaaaggcaacctaatattcctcgacgtacccaaattcgtagacggctcgtacatgcaaacgtaccattccacagtcccaaccggcgccaacatacccagtccgacagattggctgaacgccctcttcggaaatggtctgagccgatggatactaggagtgataggggtactcctaggcggactcgccctattcttcatgataatgtccctcttcaaactgggaaccaagcaagtattccggagccgaacaaaactagcgtaa

SEQ ID NO: 16557 - RNA, 3222 nt, synthetic construct
  misc_feature 1..3222: note = derived and/or modified CDS sequence (opt11) from SFTSV/Huaiyangshan virus(2010-WJ)__HQ419229.1__GP
  source 1..3222: mol_type = other RNA
atgatgaaagtaatctggttcagctccctgatctgtttcgtaatccaatgcagcggagacagcggtcccatcatatgtgcgggaccaattcatagcaacaaatcagccgatatcccccacctcctcggatacagcgagaagatctgccagatagaccgtcttatccatgtgtcatcatggctaagaaaccactcccagtttcaaggatatgtaggcaaacgagggggccgctcgcaagtaagctactacctagccgaaaatagctatagcagatggtcaggattgctctcgccctgcgacgccgattggctaggcatgctggttgtgaaaaaggcgaaagggagcgacatgatcgtacctgggcccagctacaaaggcaaggtcttcttcgagcgtccaacattcgacggatatgtggggtggggatgcggatcaggaaaaagccggaccgaaagcggagaactttgctcaagcgacagcggaacctcgtcgggactcctaccctcagacagggtcctgtggataggtgacgtcgcatgccagcctatgacaccgattccggaggagacgttcctagagctaaagagcttcagccaatcagagttcccggacatctgcaaaatcgacggaatagtctttaaccagtgcgaaggcgagagcctgccacagccatttgacgtagcctggatggatgtgggccactcccacaaaataataatgcgcgaacacaaaacaaaatgggttcaagaaagcagttcaaaagacttcgtatgctataaagaaggtacaggcccctgttctgaaagcgaggagaaaacatgtaaaacctcaggtagctgcagaggagacatgcaattctgcaaggtcgccggatgcgaacacggcgaagaggcgtcggaagcaaaatgccgatgcagtctagtacacaaaccaggtgaggtggtcgtttcatacggaggcatgcgagtccgtcccaaatgctacggcttttcaagaatgatggccaccctagaagtgaaccaaccagaacaaagaattggccagtgcaccggttgccaccttgagtgcatcaacggcggcgtgagactcatcacgctcacgagcgaactcaagagcgcgaccgtatgcgcgagccacttctgcagctcggcaacaagcggaaagaaaagcacagagatccaattccacagtggctcgctagtaggcaagactgcaatccacgtcaagggtgcactcgtggacggaacagagttcacattcgaaggaagctgcatgttcccagacggatgcgacgccgtagactgcaccttctgccgcgagttcctcaagaacccacaatgctatcccgccaagaaatggctgttcatcataatcgtgattctactggggtacgcgggcctgatgcttctcacaaacgtgctcaaagccataggaatctggggaagctgggtcattgcccccgtaaaactcatattcgcaatcataaagaaattaatgcgcacagtatcctgcctaatgggcaaactgatggatcgtggacggcaggtcatacatgaagaaataggagaaaacagggaaggtaaccaagacgatgtacgcatagaaatggccaggccacgacgcgtccgacactggatgtacagcccagtcatcctcacaatattggcgatcggactcgcggaatcctgcgacgaaatggtgcacgcagacagcaagctagtatcgtgcagacaaggcagtggcaacatgaaagaatgcgtgaccacgggcagagccctgctgccggccgttaacccaggtcaagaagcatgcctgcacttcaccgcgccgggctccccagactcgaaatgcttaaaaataaaagtaaaacgaatcaacttaaaatgcaagaaaagctcgagctactttgtaccggacgcccgaagtaggtgcacctctgtgcgacgatgccggtgggctggtgactgccaaagcggatgcccgccccacttcacgcccaacagtttcagcgacgattgggccggaaaaatggacagggccggactcggcttcagcggctgtagcgacggctgcgggggtgccgcctgcggatgcttcaacgcagccccaagctgcatcttctggagaaaatgggtcgaaaaccctcacggaataatatggaaagtcagcccctgcgcagcgtgggtcccatccgccgtcatcgaactaacaatgccaagcggagaggtacgaacgttccaccccatgagtgggatcccgacccaggtcttcaaaggggtcagcgtaacgtacctgggatctgacatggaagtaagcggactaacagacctgtgcgaaatagaagaactcaaaagcaagaaactggcactggccccatgcaaccaagcagggatgggggtagtgggcaaagtcggagaaatacaatgtagctcagaagaatccgcccgcacaataaagaaagacggatgcatctggaacgcggacctcgtagggatagaactgcgggtcgacgacgcagtgtgctacagcaaaataacgagcgttgaagcagtggctaactactcggcaataccaaccacgataggaggacttagattcgaaagaagccacgacagccagggcaagatcagcggctcgcccctggacataaccgcgattcgggggagcttctcggtgaattaccgcggtctacgcctaagcctcagcgaaattacagccacatgcacaggggaagtaacaaacgtaagcgggtgctactcctgtatgacaggcgccaaagtaagcatcaaacttcactccagcaagaactctaccgcacacgtacgatgcaagggggacgagaccgcattctcagtgctagagggcgtccattcatacaccgtgagcctaagttttgaccacgctgttgtagacgaacagtgccaactcaactgcggagggcacgaaagccaagtaacgctcaaaggcaacttaatcttcctggacgtccccaaattcgtcgatggtagttacatgcaaacgtatcacagcaccgtaccaacaggcgccaatataccaagcccgaccgactggctcaacgccctattcggcaacggccttagtcgctggatcctgggagtcataggcgtgctgctcggagggctcgcactcttcttcatgataatgtccctcttcaaactcggcaccaagcaagtcttcagaagccgcacaaaactagcgtaa

SEQ ID NO: 16558 - RNA, 3222 nt, synthetic construct
  misc_feature 1..3222: note = derived and/or modified CDS sequence (opt11) from SFTSV/Huaiyangshan virus(2010-WJQ)__HQ419230.1__GP
  source 1..3222: mol_type = other RNA
atgatgaaagtaatatggttcagctcgttgatatgcctagtcatacagtgcgggggcgacacaggcccgataatatgcgccggaccaacccactccaacaaaagcgccgatataccccacctactaggatacagcgagaaaatatgccaaatagatcggctaatacacgtatcttcctggctgagaaaccactcacaatttcaggggtacgtaggacagcgaggtggccgatctcaggtatcctactatccagcagaaaacagctacagccggtggagcggactgctctctccgtgcgacgcggactggctaggaatgctagtcgtaaagaaagccaaaggaagtgacatgatcgtcccagggccctcgtacaaaggcaaagtcttcttcgagagacccaccttcgatggatacgtaggatggggctgcggatcaggaaaaagccgaacagagagcggggaactatgtagctcagacagtggaacatcgtccgggcttctgccgagcgaccgcgtcctatggatcggcgacgtcgcctgccaaccaatgaccccgataccagaagaaaccttcctagaacttaagagcttcagccaaagcgaatttcccgatatctgcaagatcgacggcatagtattcaaccagtgtgaaggagagtccctcccccaacccttcgacgtcgcctggatggatgtcggacatagccacaaaatcataatgagggagcacaaaaccaagtgggtccaagagtcaagcagcaaggacttcgtttgctacaaagaaggaacaggaccatgttccgaatcggaggagaaaacctgcaaaaccagcggctcatgccgaggcgatatgcaattctgcaaggtcgcagggtgcgaacacggagaagaagcatcggaagcaaaatgtcgctgtagtctggtacacaagccgggagaggtagtagtatcatacggcggaatgcgagtacgaccgaagtgctacggattctcgcgaatgatggcgacactagaagtctcgcaacccgagcagaggatcgggcagtgcaccggatgccacctagagtgcataaacggcggcgtccgcctcatcaccctcacgagcgagctaaaatccgcgacggtctgcgcaagccacttctgttcgtcggcaacctccggaaagaaaagcacagaaatacagttccactccggcagcttagtcggcaagactgcgatccacgtaaaaggagccctagtagacggaaccgagttcacgttcgaaggctcatgcatgttccctgacggatgcgacgcagtcgactgcacattctgccgagagttcctcaaaaacccacaatgctacccagctaagaagtggctgttcatcatcatagtcatcctactcggatacgccggcctgatgctacttaccaatgtcctcaaggccatcggcgtctggggaagctgggtaatagcacctgtcaagctcgttttcgcaataatcaagaaactaatgcgcgccgtctcatgcctaatggggaaactaatggaccgcggcagacaagtgatacacgaagaaataggagaaaaccgggaaggcaaccaagacgacgtcagaatcgaaatggccaggccacgtagagtcagacactggatgtatagcccagtgatcctcactatcctagccatcggcctcgctgaggggtgcgacgagatggttcacgccgactcaaaactcgtctcctgcagacagggaagcggtaacatgaaagagtgcgtaaccacggggagagccctactaccggccgtaaaccccggccaggaggcctgcttgcattttaccgcacccggaagccccgactccaaatgcctcaaaataaaagtaaagcgcatcaacctgaaatgcaagaaaagcagcagctacttcgtccccgatgcaagaagcgggtgtacaagcgtgaggcgctgcagatgggcaggcgactgccagtcaggatgtcccccacatttcaccagcaacagcttcagtgatgattgggcggggaagatggatcgcgccggactcgggttctccggatgcagcgacggatgcggcggagcagcatgcggctgcttcaacgcagcaccaagctgcatcttctggcggaaatgggtagaaaacccccatgggatcatatggaaagtcagcccctgcgccgcctgggtgccctctgctgtgatcgagctcaccatgccatcgggcgaagtgcgcacattccaccccatgtcaggaataccaacacaagtattcaaaggagtctcagtcacatacctcggcagcgacatggaagtatccgggctcacagacctctgcgagatcgaagaactaaaatcaaagaaacttgccctcgccccctgcaaccaagccggcatgggagtcgtgggaaaagtaggcgagatccagtgcagctcggaagaaagcgcccgcacaatcaagaaggacggctgcatttggaacgcggacctggtcgggattgaactccgggtagacgacgcagtgtgctactcgaagatcacatcagttgaagccgtcgcgaattactccgcaatccccacgacaataggcggactacggttcgagcgttcgcacgacagccagggcaagataagtggcagcccactggacataaccgcgataaggggttcgttctccgtcaattaccgaggccttcgcctaagtctctccgaaatcaccgcgacctgcactggagaagtaaccaacgtctcaggctgttacagctgcatgacaggtgccaaagtctccattaagctgcactcgagcaagaactccaccgcacatgtacgctgcaaaggagacgagacagcattctcagtcctagaaggagtccacagttacagcgtaagcctatcctttgaccacgccgtagtagacgaacaatgccaactcaactgcggcggacacgaaagccaagtcactctgagaggaaaccttatattcttagacgtacctaaattcgtcgacggtagctacatgcaaacgtaccactccaccgtccccaccggagccaacatcccgagtcccaccgactggctgaacgcgctgttcggcaacggcttgagtcgatggatactcggagtaatcggagtgctgctgggcggactggcactcttcttcctaatcatgagcctgtttaagctcgggacaaagcagatattcaggagccgcacaaaactcgcctaa

SEQ ID NO: 16559 - RNA, 3222 nt, synthetic construct
  misc_feature 1..3222: note = derived and/or modified CDS sequence (opt11) from SFTSV/Huaiyangshan virus(2010-WSQ)__HQ419235.1__GP
  source 1..3222: mol_type = other RNA
atgatgaaagtaatttggttctcatccctaatatgcctcgtaatccaatgctccggagactctggcccaataatatgcgcaggccccatccacagcaataaatccgcaggaataccccacctactaggatactctgagaaaatctgccaaatagaccgactcatccacgtgagctcgtggttgaggaaccactcgcaatttcaaggctacgtcggacaaagaggcgggaggtcccaagtctcctactaccccgcagaaaatagctacagccgatggtcagggctcctatcaccgtgcgacgccgactggttagggatgctggtggtcaaaaaggcaaaagaaagcgacatgatcgtaccaggaccctcgtacaaaggaaaagtattcttcgaaagaccaacgttcgacggatacgtaggatggggctgcggctcgggaaaaagccgaaccgaaagtggagaactgtgtagttcagacagtggaacaagcagtggacttctaccctctgatcgggtactctggataggcgatgtcgcctgccaacccatgaccccaatccccgaagaaaccttcctcgagctaaagagcttttcccaaagcgagttcccagacatctgcaaaatagacgggatcgtcttcaaccagtgcgagggcgaaagcctgccccagcccttcgacgtagcatggatggatgtgggacactcacataaaatcatcatgcgtgaacacaaaacaaaatgggtccaggaatccagctctaaggacttcgtatgctacaaagaagggacgggcccgtgctccgagtccgaggagagagcgtgcaagacatctggttcctgccggggcgacatgcaattctgcaaagtggctggctgcgaacacggcgaagaggcatcagaagcgaaatgccggtgcagtctcgtccacaaacctggcgaagtcgtcgtatcctacggaggcatgcgcgtacgcccaaaatgctacggttttagcagaatgatggccacactggaagtgaacccgcccgaacaacgcatcggacagtgcacaggctgccacttggaatgcattaacggaggagtacgcctcataacgctaacgtcggagctacgcagcgccacggtgtgcgccagccacttttgcagctcggccacctcaggcaagaaatcaacagaaatacacttccactccggatcactgatagggaaaactgccatccacgtaaaaggagcgctcgtagacggcaccgagttcaccttcgaaggatcctgcatgttcccggacgggtgcgacgccgtagactgcacattctgcagagagttccttaaaaacccgcaatgctacccagccaagaaatggctattcatcataatagtgatccttctggggtacgccggcttgatgctcctgacgaacgtgctaaaagccataggcgtctggggcagctgggtaatcgcacctgttaaactcatgttcgccatcatcaagaaactaatgcgaaccgtatcctgcctcgtcggtaaactaatggaccgggggcgccaggtgatccacgaagaaataggcgagaacggcgaaggcaaccaagacgatgtaaggatcgagatggcacgaccacgaagagtccgacactggatgtacagtccggtcatactgacaatcctggcgataggcctggccgaagattgtgacgaaatggtacacgccgacagcaaactcgtctcatgtagacaaggatccggaaacatgaaagagtgcataaccacaggcagggccctcctcccagccgttaaccccggccaagaagcctgcctacatttcaccgcgcctggaagtccggattcaaaatgtctcaagatcaaagtaaagagaatcaacctaaaatgcaagaaaagctccagctactttgtcccggatgcccgcagcagatgcaccagtgtgagacgatgccgctgggcgggcgactgccagagtggatgtccccctcactttaccagcaatagcttcagcgacgattgggcgggcaaaatggaccgtgcaggactaggattcagcggctgcagcgatggctgcggcggggccgcatgcggctgcttcaatgcagctccgtcgtgcatattctggagaaaatgggtggaaaacccccacggtataatatggaaagtgagcccctgcgcggcatgggtccccagtgcagtaatcgaactgaccatgccctcaggagaagtacggacattccaccccatgagcggaatccccacacaggtcttcaaaggagtaagcgtcacgtacctgggctcggacatggaagtaagcgggctcacagacctgtgcgaaatagaggaactcaaatccaagaaactcgcactagcaccttgcaaccaagcaggcatgggcgtagtaggcaaagtcggagagatccagtgcagcagtgaagagagcgcaagaacaatcaagaaagacggctgcatatggaacgccgacctggtaggcatcgagctaagggtcgatgatgcagtatgttactcaaaaataacctcagtcgaagccgtagcgaactacagcgcgatccccacaacaataggcgggctcaggttcgaaaagtcgcacgacagccagggcaaaatctctggaagccccctagatataaccgccataaggggatcattcagcgtaaattacagagggctaagactgagcctaagcgagatcaccgctacgtgcacaggcgaggtcacaaacgtgtccgggtgctattcctgcatgacaggcgccaaagtaagcatcaaattacactcatccaaaaatagcacagcccacgtccgctgcaagggagacgaaaccgcattctccgtcctcgaaggagttcactcgtacatcgtgtccctcagcttcgaccatgccgtcgttgacgagcaatgccagctaaactgcggaggccacgaatcacaagtgacactcaaaggcaacctaatcttcctcgatgtcccaaaatttgtcgacgggtcatacatgcagacgtaccactccactgtaccaacaggagccaacatcccaagcccgacagattggctcaacgcgttattcggaaacggactatcacgatggatactcggggtcatcggagtcctcctgggaggactagccctatttttcctaatcatgttcctactgaagctaggaaccaagcaagtattccgctctcgaaccaagctcgcataa

SEQ ID NO: 16560 - RNA, 3222 nt, synthetic construct
  misc_feature 1..3222: note = derived and/or modified CDS sequence (opt11) from SFTSV/Huaiyangshan virus(2010-WWG)__HQ419231.1__GP
  source 1..3222: mol_type = other RNA
atgatgaaggtgatatggttctcaacactcatatgcttcgtaatacagtgctcaggtgacagtggaccaataatctgcgcagggccgatacactcgaacaaaagcgcggacataccgcacctactggggtatagcgagaaaatctgtcaaatagaccggctaatccacgtcagctcctggctgagaaatcactcccaattccaaggctacgtcggacaaagagggggcaggtcccaagttagctactaccccgccgaaaatagctactcacgatggtccggcctactatccccctgcgacgcagactggttaggtatgctcgtcgtcaagaaggccaaaggttcagacatgatagtgcccgggcccagctacaaagggaaagtattcttcgaaagaccaacgttcgacggctacgtcgggtggggatgtggcagcgggaaatcacgcacggagtccggcgaactctgtagtagcgacagcggaacaagctcaggcctcctaccaagtgacagggtcctgtggataggcgacgtcgcatgccagccgatgacccccatacctgaggaaacattcctcgaactcaaatcctttagccaatcagagttccccgacatttgtaaaatagacggcatcgtctttaaccagtgcgaaggcgaaagcctcccgcagccctttgacgtagcatggatggacgtcggccacagccacaaaataatcatgcgagaacacaaaaccaaatgggtacaagaatcatccagcaaagacttcgtatgctacaaagaaggcacgggcccgtgcagcgaatcagaggagaaaacctgcaaaaccagcggctcctgcagaggcgacatgcaattctgcaaagtagcggggtgcgaacacggcgaagaagcaagcgaagcaaaatgccgctgcagcctcgtacataaacccggcgaagtggtcgtatcgtacgggggcatgcgagtacgaccaaaatgctacggattcccacgaatgatggccaccctagaagtaaaccagccagaacagcggataggacaatgtacaggttgccacctcgaatgcataaacgggggagtacgcctgataacccttacaagcgaactgcgctcagcgacagtatgcgccagccatttctgctccagcgcgaccagcgggaaaaagtcaaccgagatacagtttcactcaggctccctggtcggcaagacggccatacacgtaaagggggcactggttgacgggacagagttcaccttcgaaggctcgtgcatgttcccggacgggtgcgacgccgtagactgcactttctgccgggagttcctcaaaaacccacaatgttaccccgccaagaaatggctactaatcataatcgtaatactcctggggtacgccggactcatgctactaaccaacgtactcaaagcgatcggaatatggggaagctgggtgatagccccggtaaaactcatcttcgccataataaagaaactcatgagagcagtcagctgccttatgggcaaattgatggaccgcggacgccaagtaatacacgaaggcatcggggaaaaccgcgaaggaaaccaagacgacgtccgaattgaaatggcgaggccgcgacgtgtcaggcactggatgtactcacccgtaattctcaccatcctcgccataggtcttgccgaaagctgcgacgaaatggtccacgccgacagcaagctagtcagctgcaggcaaggaagcggcaacatgaaagaatgcgttaccaccggacgggcactcctcccagcagtaaacccggggcaagaagcatgcctacacttcacagctcccggatccccagacagcaaatgtctcaaaatcaaagtcaaaagaattaacctaaaatgtaagaaatccagcagctacttcgtccccgacgcccggtcacgatgcacaagcgtacgaagatgcagatgggcgggagactgccaatccgggtgtccaccccacttcaccagcaattccttctcagacgactgggcagggaaaatggacagagctgggctaggcttctccggatgctctgacggatgcggcggagcagcctgcggctgcttcaacgctgccccaagctgcatcttctggaggaaatgggtcgagaacccccacggcataatctggaaagtctctccctgtgccgcatgggtcccctcagcggtcatcgagctgaccatgcccagtggagaagtgcgcaccttccaccccatgtcggggattcctacccaagtgttcaaaggcgtcagcgtcacgtacctcggatccgacatggaggtatcaggactaacggacctatgcgaaatagaggaactgaaatctaaaaagctcgcactcgcaccctgcaaccaggccggcatgggcgtggtcggaaaagtcggcgaaatacagtgtagctcagaagaatcagcaagaacaataaagaaagatgggtgcatatggaacgcagacctagtagggatcgaactcagagtcgacgacgcagtatgctacagcaaaatcaccagcgtcgaggccgtagccaactacagcgctataccaacaaccatcggcggactaaggttcgagcgcagtcacgactcccaaggaaaaatctccggcagccccctagacataacagcgatccgagggagtttcagcgtcaactacaggggactccgactaagcctctcagaaatcacagcgacctgcacgggagaagtaaccaacgtaagcggatgctactcatgtatgacaggtgccaaagtatcaataaagctacactcaagcaaaaacagcacagcgcatgtccggtgcaagggagacgagactgcctttagcgtcctagaaggagtacactcctacacagtaagcctcagcttcgaccacgccgtggtagacgaacaatgtcaattaaattgcggaggacacgaaagccaagtaaccctgaagggaaacctgatcttcctagatgtaccaaaattcgtagacgggtcatacatgcagacctaccattcaaccgtccccactggcgcaaacatcccctcccccacagactggctcaacgcactgttcggcaatggactaagccgttggatactcggcgtaatcggagtcctactaggaggactggcgctattcttcatgatcatgtcactgttcaagctcggcacaaaacaagtattcagatcccgaacaaagctagcataa

SEQ ID NO: 16561 - RNA, 3222 nt, synthetic construct
  misc_feature 1..3222: note = derived and/or modified CDS sequence (opt11) from SFTSV/Huaiyangshan virus(2010-WWX)__HQ419232.1__GP
  source 1..3222: mol_type = other RNA
atgatgaaagtcatctggttcagctcgctcatctgcttcgtcatacaatgctccggtgactcggggcccatcatatgtgccgggcccatacactctaacaagtccgctgatatcccgcatctgctcggatactcagaaaagatatgtcagatagacagactaatccacgtcagctcgtggctacgcaaccactcccaattccagggatacgtgggccaacgcggcggacggagccaagtctcgtactaccccgcggagaacagttactccagatggtcaggcctactatctccctgcgacgcagactggctcgggatgctagtcgttaagaaagctaaaggctccgacatgatagtgcccggaccctcatacaaagggaaagtcttctttgagcgaccgaccttcgatggctacgtaggatggggctgcggctcgggcaaaagcagaacagagtccggcgaactgtgcagcagcgacagcggtacatcaagtggactgctaccatcggacagggttctctggataggagacgtcgcttgccagcccatgacgccaatcccagaggagaccttccttgagctcaagagcttttctcagtctgagttcccggacatctgcaaaatagacggcattgtattcaaccagtgcgaaggcgaaagcctcccacagccattcgacgtcgcatggatggacgtcggccactcccacaaaattattatgagggaacacaagacgaagtgggttcaggaatcttcatcaaaagacttcgtctgctacaaagaaggcacgggaccttgctcagaatcagaggagaaaacgtgcaaaacctccggctcatgcaggggagacatgcaattctgcaaagtagccgggtgcgaacacggggaagaggcttccgaagccaaatgccgatgcagcctagttcacaaacctggcgaagtagtcgtctcgtacgggggaatgcgagtccgccccaaatgctacggattctcccgcatgatggcgacactggaagtaaaccaacccgaacaacggataggccagtgtactggctgcttactcgaatgtatcaacggaggcgtccgcctcatcacgctgacgagcgagctcaaaagcgcgaccgtatgtgcatcccatttctgcagcagcgccacatccgggaagaaaagcacggaaatacaattccactcaggttcgctcgtaggaaaaaccgcaatacacgtaaaaggagcactcatcgacggaacggaatttacattcgaaggcagttgcatgttcccagacgggtgcgacgccgtggactgcaccttctgcagagagttccttaaaaacccccaatgctaccccgccaagaaatggttgttcatcatcatcgtaatcctcctagggtacgcggggctaatgctcctcacaaacgtactaaaagctataggcatctggggcagttgggtcattgcgccagtaaagctgatattcgcaattatcaaaaagctcatgcgaaccgttagttgcctcatgggaaagctaatggatcgaggacgccaggtcatccacgaagagataggagaaaaccgagaggggaaccaggacgatgtacgaatcgaaatggcacgaccaagaagagtgagacactggatgtacagtccagtcattctaacgatcttggccatcgggctcgccgaatcctgcgacgaaatggtgcacgctgactcaaagctagttagctgccgccaaggcagcggcaacatgaaagaatgcgtgaccaccggcagggcattgctaccagccgtgaaccccggtcaagaagcgtgcctacacttcaccgcgcccgggagtccagatagcaaatgcctaaagatcaaggtcaaacgcataaacctaaaatgcaagaaatcctcaagttacttcgtcccagacgcacggagccggtgcaccagcgtgcgacgatgccgatgggcaggcgactgccaatccgggtgtccccctcatttcacatcaaattccttcagcgacgactgggcggggaaaatggaccgggccggcctcggattctcagggtgctccgacggctgcggaggcgcagcatgtggctgcttcaatgcggcaccctcttgcatattctggcgaaaatgggtcgaaaacccacatgggataatctggaaagtatcaccctgcgccgcctgggttccatcagcagtgatcgagttaaccatgccaagcggggaagtgcggaccttccaccccatgagtgggattccgacccaagtatttaaaggagtctcggtcacttacttgggctcagacatggaagtctccggactaacagacctgtgcgagatcgaagaattgaaaagcaaaaagctcgccctcgccccctgcaaccaagccggcatgggtgttgtaggaaaggtcggagaaatacaatgctcaagcgaagagagcgcacgcacgattaagaaagacggctgcatctggaacgcggacctagtcggcatcgaactaagggttgatgacgctgtctgctattcaaaaataacctcggtagaggcagtagcaaactactcggcaataccaaccacaataggcggtctacggttcgagcgaagtcacgacagccaaggcaaaatctcgggctctcccctggacatcaccgcaatccgcggatcgttttcagtgaactaccgagggctcagactatcattatccgaaatcacggccacatgcaccggtgaggtcacgaacgtgagtggatgctactcctgcatgacgggggcaaaagtgagcataaaattgcactcgtctaagaactccacagcgcacgtgcgatgcaaaggcgacgagacagcgttcagcgtactcgaaggcgtccacagctacaccgtgagtctctctttcgaccacgctgtagttgacgaacaatgccaactcaattgcggaggacacgaaagccaagtgactttaaaaggcaacctcatcttcctcgatgtcccaaaattcgtagacggatcatacatgcaaacctaccatagcacggtcccgactggggcaaacatcccaagcccgacagattggctgaatgcgctgttcggcaacggcctcagccgctggatactcggtgtcataggcgtgctactgggaggactagccctcttcttcatgattatgagcctcttcaagctcggcaccaagcaagtatttaggagcagaacaaagctcgcgtag

SEQ ID NO: 16562 - RNA, 3222 nt, synthetic construct
  misc_feature 1..3222: note = derived and/or modified CDS sequence (opt11) from SFTSV/Huaiyangshan virus(2010-ZGQ)__HQ419233.1__GP
  source 1..3222: mol_type = other RNA
atgatgaaagtcatctggttcagttcactaatatgtctagtcatacagtgcggaggagacacgggccccatcatctgcgcgggcccgacacacagcaacaaatcggcagatatcccgcacttgctcggatactcagagaaaatatgccaaatcgacaggctcattcacgtaagctcctggctccgaaaccactcccaattccaaggttatgtcggacaacgcggaggccgcagccaagtctcatactacccagcagaaaactcctatagtcgatggtctggattactcagcccatgcgacgcagactggctcggaatgctggtcgtcaaaaaggccaaaggttcagatatgatagtacccggaccatcctacaagggtaaagtattcttcgaacgaccaacctttgacggctacgtgggatggggctgcggatccggcaaaagccggacagaaagcggagaactttgctcatccgactcagggacctctagcggactgttgccgtccgaccgagttctgtggataggggatgtcgcgtgccagcccatgacacccataccggaagaaacctttctagagctcaaatccttctcccaaagcgagttcccagacatctgcaaaatagacggcatagtcttcaaccagtgcgaaggggaaagcctaccgcaaccattcgatgtagcatggatggacgtagggcattcacacaagatcataatgcgagaacacaaaacaaagtgggtacaggaatcgtccagcaaagacttcgtctgctacaaagaaggaacgggaccatgctcagaatctgaagagaaaacatgcaaaacctcaggctcatgccgcggcgacatgcagttctgcaaagtagctgggtgcgaacatggcgaagaagcatcggaagccaaatgccgctgcagcctggtgcacaaacccggagaagtcgtggtatcgtacgggggcatgcgcgtacgccctaaatgctacggcttcagccgaatgatggcaacactggaagtatctcaaccagaacaacgaatcggccaatgtaccggctgccacctcgaatgcatcaatggtggagtacgcctgatcaccctaacgagcgaactcaaatcagccacggtatgcgcaagccatttttgcagctccgcaacaagcgggaaaaagagcacggaaatccaattccactcgggctccttagtcggaaaaaccgccatccatgtcaagggggcactcgtcgacggcacggagttcacattcgaaggcagctgcatgttcccggacggctgcgacgctgtagactgcacattctgcagggagttcctaaagaacccacaatgctaccccgcaaagaagtggctatttataatagtagtaattctgctgggctacgcaggactgatgctactcaccaatgtactcaaagcaatcggcgtgtggggaagctgggtcatagccccagttaaactggtgttcgcaatcattaagaaactaatgagagcagtcagttgcctaatgggaaaacttatggaccgaggacgacaggtgatacacgaagaaataggcgaaaaccgagaagggaaccaggacgatgtccggatagagatggctcgaccgcgaagagtaagacactggatgtactccccagtcatacttaccatcttagcaatcggactcgcagaaggatgcgacgaaatggtacacgcagactcaaaactcgtctcgtgcagacaggggagcgggaacatgaaagaatgcgtaaccacagggagggcacttttacctgccgtcaacccgggccaggaagcgtgcctacacttcaccgcgcctggtagcccagactccaaatgcctcaagataaaggtcaaacgaataaatctgaaatgtaaaaagtcatcgtcatacttcgtccccgacgccagaagccgttgcacctccgtacggagatgccgctgggcgggggactgtcaatccggatgcccgccccacttcaccagcaacagcttctcagacgactgggccggcaaaatggaccgggcagggctcggattctccggatgctccgacggatgcggcggagcagcatgcggttgcttcaacgcggcacccagctgtatattctggcgaaaatgggtcgaaaatccccacgggatcatatggaaagtcagcccctgcgcagcatgggtgcccagcgcagtcatcgaactgacaatgcccagcggggaagtaagaacgttccacccaatgagcgggattcccacacaagtattcaagggagtaagcgtaacatacctaggatcggacatggaagtaagcggactcacggatctatgcgagatcgaggaactcaaatcgaaaaagctagcgctggcgccatgcaaccaagcaggaatgggggtcgtgggaaaagtcggcgagatacaatgcagcagcgaggaatcagcacgaaccatcaagaaagacggctgtatatggaatgcggatctcgtcggcatagagctccgggtagacgacgcagtatgctattccaaaatcacttcagtcgaggcagtggccaactacagcgcaatcccaacaaccatcggtggcctcagatttgagcgctcacacgactcacaaggaaagatcagcggcagtcccctggacattaccgcaataagaggctcattcagcgtcaactaccggggcctccgcctcagcctaagcgaaatcacggcaacgtgcaccggcgaagtaacaaatgtaagcggctgctatagctgcatgaccggagcgaaagtgagcataaaactacactcatcgaaaaattccacagcccacgtgcgctgcaagggcgacgagaccgcattctccgtactcgaaggagtccacagctactcagtaagcctctcatttgaccacgcagtcgtagacgaacagtgccaactaaattgtggagggcacgagtcacaggtcacactacgcggaaacctaatcttcctcgacgtaccaaaattcgtagacggctcgtacatgcaaacctaccacagcaccgtcccaacgggagccaacataccgtcccccacggactggttaaacgccctattcggcaacggtttgagccggtggatcctaggagtgatcggagtactactaggcggtctcgccctatttttcttaatcatgtcactcttcaaactaggcacgaaacagatattccgatcccgcacgaagctcgcctag

SEQ ID NO: 16563 - RNA, 3222 nt, synthetic construct
  misc_feature 1..3222: note = derived and/or modified CDS sequence (opt11) from SFTSV/Huaiyangshan virus(M-HZM)__JF951393.1__GP
  source 1..3222: mol_type = other RNA
atgatgaaagtaatttggttcagcagcctaacctgcctagtgatccaatgcagcggggattccggacccatcatctgcgcagggcccatacactcaaataaaagcgccggaatcccacatctcctagggtactcagagaaaatctgtcaaattgacagactcatccacgtaagctcgtggctaaggaaccacagccaattccagggatacgtaggccaacgcggaggacgcagccaggtctcatactatcccgcagaaaactcctacagtcggtggtcaggactactcagcccatgcgacgcagactggctagggatgctcgtagtaaagaaagcaaaagaatccgatatgatcgtaccgggaccctcctacaaaggcaaagtattcttcgaaaggcctaccttcgacggctacgtaggctggggctgcgggtcaggtaaatctcgcacggaatccggcgaactctgctcaagtgactcaggcacgtccagcggcctactcccatccgaccgagtactctggatcggtgacgtggcgtgccaacccatgaccccaataccagaagaaaccttcctagaactcaaatcctttagccaatctgagttcccagacatctgcaaaattgacggcatagtctttaaccagtgcgaaggcgaatccctcccccaaccattcgacgtggcctggatggacgtcggccacagccacaaaataataatgcgcgagcacaaaaccaaatgggtacaggaaagctcatccaaagacttcgtatgctacaaagagggaaccggtccatgttccgaatcagaggagaaagcgtgcaaaacaagcgggagttgccgaggagacatgcaattctgcaaagtagcgggctgtgaacacggagaagaggcaagcgaagcaaagtgtcggtgctccctagtacacaaacccggtgaagtggtcgtctcatacgggggaatgcgagttagacctaaatgctacggattctccagaatgatggccacattggaagtaaacccacccgaacaacgaatcggccaatgcactggctgccacctcgagtgcataaacggaggcgtccgcctcataacgctaacctccgagctaaggagcgcaacagtctgcgcgtcccacttctgctcctccgcaacttcaggcaagaaaaacacagaaatacacttccattcaggcagcttagtaggaaaaaccgccatccacgtgaagggcgcactcgtcgacggcactgagttcaccttcgaagggtcctgcatgttccccgacggctgcgacgccgtcgactgtacgttctgccgagagttcctgaaaaacccccagtgctaccccgctaagaaatggctattcataataatagtcatactccttggatatgcaggcttaatgttgctgacgaacgtcctaaaagcaataggtgtctggggctcatgggttatcgcacccgtaaaactaatgtttgcaatcataaagaaactgatgcgaacggtatcctgcctagtaggcaaactcatggaccgaggccgccaagtgatccacgaagaaataggcgaaaacggagaaggaaatcaagatgacgtacgcatcgaaatggcacgccccagacgcgtgcggcactggatgtacagcccagtcatactcactatcctagccatcggcctagccgaaggatgtgacgaaatggtacacgccgacagcaaactcgtatcatgcagacaaggttccggaaacatgaaagaatgcatcacgaccggacgcgcactactaccagctgtaaacccggggcaggaagcctgcctacacttcacagccccaggctcccccgacagcaaatgtctcaaaataaaagtcaaacgaatcaatctcaaatgcaagaaatccagctcatacttcgtgcccgacgcgagatcccgctgcaccagcgtaaggcgctgccggtgggctggcgactgccaaagcggctgcccaccgcatttcacatcaaactccttctccgacgactgggccggaaaaatggacagggctgggcttggcttctcgggctgcagtgacggctgcggcggagctgcgtgcggatgcttcaacgcagcgccatcctgcattttctggcgcaaatgggtcgaaaacccccacggcatcatctggaaagtcagcccttgcgccgcatgggtcccatccgccgtgatcgaactgaccatgccatcaggcgaagtacgcaccttccaccccatgtcaggaatccccacacaggtcttcaaaggagtgagcgtaacatacctcgggagcgacatggaagttagcggactaacggacctatgcgaaatcgaggaactaaaaagcaaaaagctagcgctcgccccatgcaatcaagctggcatgggagtagtcggtaaagtcggcgagatccaatgcagcagcgaagaatcggcccgcacaatcaagaaagacgggtgcatatggaacgccgacctagtcgggatcgagctgcgcgtagacgacgccgtctgctactccaaaatcacgagcgtagaagctgtagccaactacagcgccatacccaccaccatcggaggactccgattcgaacgaagccacgactcacaaggaaaaattagcggatccccgctagacatcaccgcaatccgtggatccttctcggtcaaccttagaggactccgcctctcactcagcgaaatcacagcaacatgcaccggcgaggtcacaaacgtctcgggctgctactcttgcatgacaggcgccaaagtgtctatcaaactccactcaagcaaaaacagcaccgctcatgtccgatgcaaaggcgatgagaccgccttctctgttctagaaggcgtccactcttacatagtaagcctatcctttgaccatgccgtggtcgacgagcaatgccagctcaactgcggaggtcacgagtctcaagtgacactcaagggcaacctaatcttcctcgacgtcccaaagttcgtcgacggcagttacatgcaaacctaccactcgacagtcccaacaggagcaaatataccctcaccgacagactggctgaacgctcttttcggcaacggcctaagccgatggatactaggtgttataggcgtcctgctaggaggactcgctctgttcttcctaataatgttcctcctcaaactaggcacaaagcaggtattccgatcacgcaccaaactcgcataa

SEQ ID NO: 16564 - RNA, 3222 nt, synthetic construct
  misc_feature 1..3222: note = derived and/or modified CDS sequence (opt11) from SFTSV/Phlebovirus(AH15/China/2010 strain AH15)__HQ141593.1__GP
  source 1..3222: mol_type = other RNA
atgatgaaagtcatctggttcttctccctgatttgcctagtcatacagtgcggtggagacacagggccgataatctgcgcaggaccgatccacagcaacaaaagtgccgacatcccgcacctcttgggttacagcgaaaagatatgccagatcgaccggctgatacacgtaagttcgtggctaaggaaccattcccagttccaagggtacgtaggacaaagagggggcagaagccaagtctcgtactaccccgcggaaaactcctattcaagatggtcgggcttactcagcccatgcgacgcagattggctaggcatgctcgtcgtaaagaaagcgaaaggatcagacatgatcgtacccgggccaagctacaaaggcaaagtcttcttcgaacggccgacctttgacggatacgtcgggtggggctgtgggtcaggaaaaagccgaacagagagcggggaactgtgcagcagtgactccggcacctccagcggacttctgccaagtgacagagtcctgtggattggcgacgtagcatgtcagcctatgaccccgataccggaagaaacgttcctagaactaaagagctttagccaatcagagttcccagacatatgcaaaatcgacggcatagtattcaaccagtgcgaaggtgaatcgttaccacaacccttcgacgtagcttggatgggagtagggcacagccacaaaatcataatgagagaacacaaaacgaaatgggtacaggaatccagctcaaaagacttcgtatgctacaaagaaggcacgggaccctgcagcgaatcagaagagaaaacctgcaagaccagcggctcgtgccgaggagacatgcaattctgcaaagtggccggatgcgaacacggagaagaagcaagcgaagcaaaatgtcgatgctccctagttcataagccaggcgaagtagtggtttcatacggaggaatgcgagtgagacccaaatgttacgggttctcgcggatgatggccaccttggaagtgaacgaaccagagcaaaggataggacaatgcacaggatgtcacctcgaatgtataaacggaggcgtccgactgataaccctaacaagcgaactcaagagcgcaaccgtatgcgcctcccacttctgctcatccgccacaagcggaaagaaaagcacggaaatacaattccactcaggcagcctcgtaggcaaaacagcgatccacgtaaagggggcactcgtggacggtaccgagttcacattcgaaggctcctgtatgttcccggatggctgcgatgcagtggactgcactttctgtcgggaatttctaaagaacccgcaatgctaccctgcaaagaaatggttattcatcataattgtaatactactagggtacgccggcctaatgctactgaccaacgtgctgaaggcaatcggagtgtgggggtcatgggtaatcgcccctgtaaaactggtcttcgcgatcataaagaaactaatgcgagcggtatcatgcctaatggggaaactaatggaccgaggtcggcaagtcatacacgaagaaatcggagaaaacagagaggggaaccaagacgatgtccgaatagaaatggcgagaccacgccgcgtacgacactggatgtacagtcccgtcatactaaccatcctagccatgggcctcgccgaaggatgtgacgaaatggtacacgcggactcgaagctggtgtcatgcaggcaaggaagcggcaacatgaaagagtgcgtaaccacgggcagagcgctactaccggcagtgaatccgggacaagaagcctgtctacatttcacagcgcccggctcaccagactcgaaatgtctcaagataaaagtaaagcgcataaacctaaaatgtaagaaaagcagctcctacttcgtgccggacgcccgaagccggtgcacgtcagtgcggcggtgccggtgggcaggagactgccaaagcggatgcccgccccacttcacgagcaacagttttagcgacgactgggccggaaaaatggacagagccggactcgggttctcgggctgctcggacggctgcggcggcgcagcatgcgggtgcttcaacgcggcacccagctgcatcttctggcgcaaatgggtagaaaacccgcacgggatcatctggaaagtcagtccgtgtgcagcgtgggtcccaagtgccgtgatcgaactcacaatgccatcgggagaagtgcgaactttccacccgatgagcgggatcccaacacaagtctttaaaggagtctctgtcacgtacctcggatcggacatggaagtatcaggtctcacagacctgtgcgagatcgaggaactcaaaagcaagaaactcgcgctagcgccatgtaaccaagcaggaatgggcgtggtgggcaaagtcggggaaatacaatgtagcagcgaagaaagcgcaagaacgataaagaaagacggatgcatctggaacgcagatctggtgggaatagaactcagagtcgacgacgcggtgtgctactccaaaatcacaagcgtcgaagcggtggcaaactactcagcaataccgaccaccataggaggactgcggttcgaacgcagccacgacagccaaggcaaaatatcgggctccccgctggacataacagcgataagaggatctttcagcataaactaccgaggcctccgcctgagcctgacagaaataacagccacgtgcaccggggaagtcacgaacgtaagtggctgctacagctgtatgacaggagccaaagtaagcatcaaattgcactcgagcaaaaactccacagcccacgtacgatgcaaaggggatgagacagcttttagcgttctagaaggagttcacagctatagcgtgagcttaagttttgaccacgcagtagtcgatgaacagtgtcagctaaactgcgggggccatgaaagccaagtgacactccgggggaacttaatctttctagacgtccccaaattcgtggacggcagctatatgcaaacctaccacagcaccgtaccaacaggggccaacatcccgagcccaactgactggctgaacgctctcttcggaaacggccttagtcgctggatccttggtgtaatcggagtactcttgggcgggctagcgttgttcttcctcatcatgtccctgttcaaactaggaacaaagcaagtgttccgaagcagaacaaaactcgcgtga

SEQ ID NO: 16565 - RNA, 3222 nt, synthetic construct
  misc_feature 1..3222: note = derived and/or modified CDS sequence (opt11) from SFTSV/Phlebovirus(HN6/China/2010 strain HN6)__HQ141596.1__GP
  source 1..3222: mol_type = other RNA
atgatgaaagtaatatggttcagctcactaatatgctttgtaatacaatgcagtggtgacagcgggccaatcatctgcgctgggcccatccacagcaacaaaagcgcagatatccctcacctcctcggctacagcgaaaagatatgccaaatagaccgactaattcacgtctcctcctggctccgcaaccactcacaattccagggctacgtgggccaacgaggcggccgaagccaagtatcctattaccccgccgaaaatagctacagtcggtggagcggcctactgtcaccgtgcgacgccgattggctcgggatgctagtagtgaaaaaggccaaaggctcagacatgatagtaccagggccgtcatacaaaggaaaggtattcttcgagcgcccaaccttcgacggatacgtcggttggggctgcggaagcggtaaaagcagaaccgagtcaggcgagctatgctcctcagacagcgggacatccagtggcctgttgccatctgaccgggtcctctggatcggcgacgtcgcatgccaacccatgacaccgataccggaagagaccttcctcgagctaaagagttttagtcaatcagagttccccgatatctgcaaaattgacggaatcgtctttaaccaatgcgagggagaatccttaccacaacccttcgacgtggcatggatggacgtaggccacagccacaagataatcatgcgagaacataaaaccaaatgggtacaagaatcaagtagcaaagacttcgtatgctacaaggagggcacaggaccctgcagcgaaagcgaagaaaagacgtgcaagaccagcggcagttgccgaggcgacatgcaattctgcaaagtagcaggatgtgaacacggggaagaggcttcggaggcaaaatgccgatgcagtctcgtacacaaacctggggaagtcgtcgtaagctacggaggaatgcgcgtccggccaaaatgctacggattctcccgaatgatggcaacactcgaagtaaaccaacccgagcaacgcatagggcaatgcacagggtgccacttagaatgcattaacggaggggtacgactcatcaccctgacgtcagagctaaagagtgcgaccgtttgcgcatcacacttctgcagctcagcaacgtctgggaaaaagagcaccgaaatccagttccactcgggaagtctagtaggaaaaacggcgatacacgtaaaaggagcactcgtagatggaaccgagttcacattcgaaggcagctgcatgttccccgatggatgtgacgccgtcgactgcaccttttgcagggagttcctcaaaaacccacagtgctaccccgctaagaaatggctattcatcataatcgtcatcctactgggatacgccggactaatgctattaacgaacgtcctaaaagccataggcatctggggatcctgggtaattgcgccagtgaaactgatattcgcgatcatcaaaaagctaatgcgcacagtaagctgcctggtcggaaaactcatggaccgaggccgacaagtcatacatgaagaaataggcgaaaaccgagaaggaaaccaggacgatgtcagaatcgaaatggcgcgaccccggcgggtccggcattggatgtacagtccagtcatactgacaatcctagccataggcctagcagagtcctgcgacgagatggtccacgcagactcaaagctggtatcatgccgccaggggtccggaaacatgaaggaatgcgtcaccacaggaagggcacttctccccgccgtcaacccaggacaagaagcatgccttcatttcaccgcacccggcagccccgacagcaaatgtttgaagataaaagtcaaacgcataaacctgaagtgcaagaaaagctcgtcatacttcgtaccagacgcaagaagtaggtgcacgagcgtacgtagatgccgctgggccggcgactgccagagcgggtgcccaccccacttcacaagcaactctttcagcgacgactgggcgggaaaaatggatcgagccggactggggttcagcggctgcagcgacggatgcggcggagccgcctgcggatgcttcaacgcagccccgagctgcattttctggcgcaaatgggtagagaacccacacggcataatatggaaagtgagcccgtgcgcggcgtgggtcccaagcgcggtaatagagctcaccatgccaagcggggaaatgcgaacgttccacccaatgtccgggattccaacacaagtattcaaaggcgtaagcgtcacatacctaggctcagacatggaagtcagtggactaacggacctatgtgagattgaggagctaaaatcaaagaaactagcactcgccccatgcaaccaagccgggatgggggtagtgggcaaagtcggggaaatacaatgcagtagcgaggaatccgcacgaacaatcaagaaagatgggtgcatctggaacgcagacctagtaggaatagaactccgagtcgacgacgccgtatgttacagcaaaatcaccagcgtagaagccgtggccaactattcggcgataccaaccaccataggcggccttagattcgagcgcagccacgacagccagggcaaaatctctggatcaccactggacataaccgccataagaggctccttcagcgtaaactacagaggccttcgactgtccctatcagagataaccgcaacatgcacaggcgaagtcacaaacgtcagcgggtgctactcttgcatgacaggcgcaaccgtatcaattaaactacacagtagcaaaaacagcacagcccacgtgcgctgcaaaggcgacgaaaccgcgtttagcgtactcgaaggcgtacacagctacacagtcagcctatcgttcgaccacgccgtcgtagacgaacagtgccaactcaactgcggcggacacgaaagccaagtgacactcaaaggaaacctcatcttcctcgacgtccccaaattcgtcgatggaagctacatgcagacataccattccacagtgccgacgggcgcaaacatcccgagcccaacggactggcttaacgcattattcggaaacggcctgagccggtggatcctcggcgtgatcggcgtgctcttgggcggactagccctattcttcatgataatgagcctattcaagctcggaactaaacaggtattcaggtcccgaaccaaactcgcctga

SEQ ID NO: 16566 - RNA, 3222 nt, synthetic construct
  misc_feature 1..3222: note = derived and/or modified CDS sequence (opt11) from SFTSV/Phlebovirus(JN1/China/2010)__JN258706.1__GP
  source 1..3222: mol_type = other RNA
atgatgaaagtcatttggttttcatccctcatatgcctcgttatacaatgcagcggagactcaggccccatcatatgcgcgggacctatccactccaacaaatccgccgggataccgcatctgctagggtactcggagaaaatatgccaaatagatcgactcatccacgtctcatcatggctaagaaaccactctcaatttcaaggatacgtgggccagaggggaggcaggtcccaagtctcatactaccccgcagaaaatagctacagtcgctggtccggactgctatcaccatgtgatgcagactggctaggaatgctagtagttaaaaaggccaaggaatcagacatgatagtacccggaccatcgtacaaaggcaaagtattcttcgagagaccaaccttcgatgggtacgtaggctggggctgcggaagcggaaagagcagaaccgagagcggggaactgtgctcaagcgatagcggcacgtcatccggactcctaccttcggaccgggtgctatggataggcgacgtcgcatgccaacccatgacaccaattcccgaagagacctttctcgaacttaagagcttttcccagagcgagttccccaacatatgtaagatcgacggaatcgtctttaaccaatgcgagggagaatcactcccccaacccttcgacgtagcatggatggatgtagggcactcacacaaaataataatgcgagaacacaaaaccaaatgggtccaggagagcagcagcaaagatttcgtatgctacaaagaaggtacagggccctgctccgagagcgaagaaaaagcatgcaaaacatcgggatcatgcagaggcgacatgcaattttgcaaggtagcaggctgcgaacacggggaagaggcttcagaagcgaaatgccgttgctccctagtccacaaacccggcgaagtcgtcgtctcttacggaggcatgcgcgtccgccccaaatgctacggattctcgcgcatgatggcgacgctagaagtaaacccaccagagcaaaggatcggacaatgcacaggctgccaccttgaatgtataaacggcggcgttagattagtcacactaacgagtgaactcagaagcgctacagtgtgtgcatcccacttctgctcatcggcaacgagcggaaagaaaagcacggagatacacttccactccggctccctcgtgggaaaaacagcgatacacgtcaaaggagcgttagttgacggcaccgagttcacgttcgaaggatcgtgcatgttcccagacgggtgtgacgcggtagactgtacattctgccgagagttcctcaaaaacccgcaatgctaccccgccaagaagtggctattcatcatcatcgtgatcctactagggtacgcgggcttaatgctactaacaaacgtgctcaaagccataggcgtgtggggcagctgggtaatagcccccgtaaagctcatgttcgcaataatcaaaaagctcatgcgaaccgtctcctgcctcgtaggcaaattgatggaccgagggcgacaggtcatacacgaagaaataggcgaaaatggcgaaggaaaccaagatgacgtcagaatagaaatggcgcgcccacgacgagttcgccactggatgtacagcccagttatactgacgatcttagccatcggtctggcagaaggttgcgacgaaatggtgcatgccgatagcaaattagtctcctgccgccaaggaagcggaaacatgaaagaatgtattacaacggggagagcactactacccgcggtgaacccaggtcaggaggcttgcttacactttactgcccccggaagcccagacagcaaatgtctaaaaatcaaagtcaaacgaatcaacttgaagtgcaagaaatcatcaagctacttcgtaccagacgcacggagcagatgcaccagcgtacgtcggtgtaggtgggcaggagactgccagtcaggatgcccgccccacttcaccagcaatagctttagcgacgactgggccggcaaaatggatagagccgggctaggtttctcaggatgcagcgatggctgcggaggagcagcctgcggatgcttcaacgcagccccgtcctgcatattctggcgaaaatgggtagaaaacccacatgggatcatatggaaagtatcaccttgcgcagcatgggtgccttcagccgtcatcgaactaacgatgccctcaggagaagtacgcacgttccaccccatgagcggaataccgacccaggtgttcaaaggggtatctgtaacgtacctgggatccgacatggaagtgagtgggctgacggacctgtgcgagatagaggaacttaaatcgaagaaactcgcgctagcgccctgcaatcaggctggaatgggagtggtcggcaaagtaggagaaatacaatgcagttccgaagagtctgcaagaacgataaagaaagatggttgcatatggaacgccgacctcgtcggaatcgagctccgggtagacgacgcagtctgctactcaaaaataacctcggtcgaagctgtagccaactactcagcaattcccacgaccatcggagggctccggttcgaaagatcgcacgactcacagggcaaaatcagcggctccccactagacataaccgcaatacggggatctttctcggtcaattaccggggactccgcctatccttgtcagaaatcacggctacttgcacgggcgaagtcacgaacgttagtggttgctacagctgtatgaccggagcaaaagtcagcataaaactccactcttccaaaaactcaacagcacacgtccgatgcaaaggagacgaaaccgcattctcagtcctaaaaggagtccactcatacatcgtaagcctctctttcgatcacgccgtggttgatgagcagtgccagctaaactgcggcggccacgaatctcaagtaaccctcaaaggaaacctaatcttcctagacgtaccaatattcgtcgatgggtcatacatgcagacctaccattcgacggtcccgaccggggccaacatcccgtccccgaccgactggctgaatgcactcttcggtaacgggctgagccgatggatactcggggtcataggcgtactactcggcggactagcactatttttcctcatcatgttcctactaaaactaggcacaaaacaggtgtttcgaagcagaaccaaactggcatga

SEQ ID NO: 16567 - RNA, 3222 nt, synthetic construct
  misc_feature 1..3222: note = derived and/or modified CDS sequence (opt11) from SFTSV/Phlebovirus(JS2010-014)__JQ317170.1__GP
  source 1..3222: mol_type = other RNA
atgatgaaggtgatatggtttagctacctcatctgtttcgtcatccaatgctcaggagactcggggccaataatatgggcaggtccgatacatagcaacaaatccgcagacataccccacctcctcggatacagcgagaaaatctgccagatagaccgcctaatacacgtcagctcctggctacgaaaccactcacagttccaggggtacgtcggccagcgcggaggaagaagccaggtctcatactaccctgccgaaaacagctattccagatggagtggactactatcaccatgcgacgccgactggctcggcatgctggtcgtaaagaaagccaaaggatcggacatgatcgtcccaggtccgtcatacaagggaaaggtattctttgaacgcccaaccttcgacggctatgtaggctggggatgtggctcggggaaaagccgaaccgaaagcggggaactctgcagctccgactcaggcaccagttccggcttgctcccaagcgaccgcgtcctctggatcggcgatgttgcctgccagccaatgacaccgatacccgaagaaacgttcctagaactaaaaagtttcagccaaagtgagttcccagacatatgcaagatagacgggatagttttcaaccagtgcgaaggagaaagcctgccacaaccttttgacgtggcctggatggatgtagggcacagccataaaataataatgcgagaacacaagacaaaatgggtacaggaaagcagctcgaaggatttcgtatgctacaaagagggaacaggcccatgctccgagagcgaggagaaaacctgcaaaacatccgggagctgccgcggcgacatgcagttctgcaaggtggctggatgcgaacacggcgaagaagcctcggaagctaaatgtaggtgcagcctagtacacaaaccgggagaagtcgttgtctcatacggtggtatgcgcatacgacccaaatgttacggcttctcacgaatgatggcgaccctagaggtaagccaacccgagcagcgactcggacaatgcaccggatgccacctagaatgcataaacggaggcgtgcggctgataacactaaccagcgaactaaaatccgcgacggtctgcgcgtcccacttctgctcgtccgccacaagcgggaagaaaagcacggaaatacaattccacagcggcagcctagtcgggaaaacggcaatccacgtgaaaggcgccttggtggacggcacggaatttacgttcgaaggatcatgcatgttccccgacggctgtgacgcagtggactgcaccttctgcagagagttcctgaaaaacccacaatgctatcccgccaagaaatggctctttataatcatagtgatactcctcggctacgcaggcctaatgttactcacaaatgtcctaaaggcgatcggaatatggggctcatgggtcatcgcgccggtaaaactcatgttcgccatcatcaagaaattgatgaggaccgtgagctgcctcatgcgaaaactgatggaccgagggcgacaggtcattcatgaagagattggagaaaacagagtaggaaaccaggacgacgtcaggatcgagatggcgcgcccccgacgagtaagacattggatgtacagtcccgtcatcctgaccatcctggcaatcggcctagcagagagctgcgacgaaatggtacacgcagactcgaagctagttagctgccgacaaggaagcgggaacatgaaagaatgcgtaactacaggccgggccctgctcccagccgtgaaccccggccaagaagcgtgcctccatttcaccgctccaggaagccccgacagcaaatgcctcaaaataaaagttaagcggataaacctcaaatgcaagaaaagttcaagctatttcgtccctgacgcgaggagccgatgcacatccgtacgccggtgtaggtgggcaggagactgccagagcggatgtcccccacacttcacatcaaactcattcagcgacgactgggcgggaaaaatggaccgagcaggcctgggcttttcgggatgcagcgacggctgcgggggagccgcctgcggctgcttcaacgccgcacccagttgcatcttctggaggaaatgggttgaaaatccccacggtattatctggaaagtatcaccttgcgcagcatgggtaccatcggcagtaatagaactcaccatgcccagcggcgaagtgcgcaccttccacccgatgtccggaatcccgacccaagtcttcaaaggagtatcggtcacctacctcgggagcgacatggaggtaagcggactaacagacctatgcgaaatagaagaacttaaaagcaagaaactcgctctcgccccttgcaatcaggcgggaatgggcgtagtcggaaaagtaggcgaaatccaatgctcatccgaagagagcgcgcgcactatcaagaaagacggatgcatttggaacgcagatctcgttggaatcgaactaagagtcgacgacgccgtatgctactccaaaatcactagcgtggaagcagtcgccaactacagtgccatccccacaacgatcggcggcctccgcttcgaacgctcacacgacagtcaagggaaaatttcaggatcaccacttgacataacagcaatacgagggagctttagcgtcaactacagaggactacgcctctcactaagtgaaatcacggcaacatgcaccggagaggtaacgaacgtgagcgggtgctacagctgcatgacaggcgccaaagtctcaataaaattacactcatccaaaaatagcaccgcgcacgtacgctgcaaaggagatgaaacggcattctccgtcctggaaggagtacactcctacaccgtctcactcagcttcgaccacgcagtggtcgacgaacagtgccagctcaactgcggcggacacgaatcccaagtgactttaaaaggaaatctgatcttcctggacgtaccgaaattcgtggatggctcatacatgcaaacatatcacagcaccgtccccaccggagccaacataccgagccccacagactggcttaacgcactgttcggaaacggtctcagccgatggatactaggagtcatcggggtactccttggagggctagccctcttcttcatgataatgagtctgttcaaacttggcacaaaacaagtcttccgaagccgaacaaaactcgcctag

SEQ ID NO: 16568 - RNA, 3222 nt, synthetic construct
  misc_feature 1..3222: note = derived and/or modified CDS sequence (opt11) from SFTSV/Phlebovirus(JS2010-015)__JQ317173.1__GP
  source 1..3222: mol_type = other RNA
atgatgaaagtcatatggttcagctcactcatatgcttcgtaatacaatgcagcggagactccggcccgataatatgtgcaggaccaatccacagcaacaaatcggcggacataccccacctcctaggttactccgagaaaatatgccaaatcgaccgactaatccacgtcagcagctggctaagaaaccattcacaattccaaggctacgtaggccaacgcggcggccgatcgcaggtatcctactaccccgccgaaaactcctacagccggtggtcgggactactgagcccatgcgacgcagactggctcggcatgttagtcgtgaagaaagccaaaggatccgacatgatagtccccggaccgtcgtacaagggtaaagtcttcttcgaaagaccgaccttcgacggctacgtaggctggggatgcggctccggcaaaagccggaccgaaagcggggaactctgctccagcgactcagggacctcatcaggtctactaccaagcgaccgcgtcttatggatcggcgacgtagcctgccaacccatgaccccgattccggaagagaccttcttagagctaaaaagtttcagccaatccgagttcccagacatctgcaaaatcgacggaatcgtattcaaccaatgcgaaggagaaagcctcccacagcccttcgacgttgcatggatggacgtaggacactcacacaaaatcataatgcgagaacacaaaaccaaatgggtccaagaatcatcgagcaaagacttcgtctgctacaaggaagggacgggcccctgctcagaatccgaggagaaaacctgcaaaacctcaggcagctgccggggcgatatgcagttctgtaaagtagccggctgcgaacatggagaagaagcatcggaagcgaaatgtagatgcagtctcgttcacaaaccgggcgaggtagttgtcagttacggaggaatgagagtacgcccaaaatgctacggcttcagcagaatgatggcaacattggaggtcaaccaacccgaacaacggatcgggcagtgtacaggatgccacctagaatgcataaacggcggggtccgcctcatcacgctcacaagcgaactcaaaagcgcgaccgtttgcgctagccacttctgcagcagcgccacttccggcaaaaagagcacggaaatacaattccactctggctcgttggtaggaaagaccgcgatacacgtcaaaggagcactggtagacgggacagagttcacctttgaaggatcttgcatgttcccagacggatgcaacgcggtcgactgtacattctgccgagaatttctcaaaaacccacaatgctacccggctaagaaatggctgttcatcataattgtcatcctcctgggatatgcaggcctaatgttactcactaacgttctgaaagcgataggcatctggggatcctgggtaatagcaccagtaaaactcatgttcgcgataatcaagaaactaatgcgtacggtatcatgcttaatgggcaaactgatggaccggggacgacaagtaatacacgaagaaataggagagaacagggaaggaaaccaagacgatgtccgaattgaaatggcacgcccaaggagagtgcgtcactggatgtacagccccgtcatactgacattcctggccatcggcctggctgaaagttgtgacgaaatggttcacgcagactcaaaactggtgtcatgcagacaaggcagcggaaacatgaaggagtgcgtcacaaccggccgagcgctgctcccggccgtgaacccgggccaagaggcttgcctccattttaccgcacccggcagccctgactcaaaatgcctcaaaatcaaggtgaagcgaattaacctgaaatgcaagaaaagttccagctacttcgtacccgacgcccgaagccgttgcacctcagtaaggaggtgccgatgggccggcgactgccaatccggatgtcccccacattttacctcgaactccttcagcgacgactgggcgggtaaaatggacagggccggcctgggcttcagcggctgcagcgatggctgcggcggagcggcctgtggctgcttcaacgcggcgccatcatgcatcttctggagaaaatgggtcgaaaacccacacggcataatttggaaagtatccccttgcgccgcttgggtcccctcggcagtaatagaactaaccatgccatccggtgaagtgcgaacgttccaccccatgtcagggatccccacccaggtattcaaaggcgtctcggtaacgtacctagggtcagacatggaagtgagcggcctaacagacctatgcgaaattgaagaactcaaaagcaagaaattagcgcttgcgccctgcaaccaagccggaatgggagtcgtaggcaaagtcggggaaatccaatgcagttcagaagagtcagcacgaaccataaagaaagacggctgcatctggaacgcagatctggtcgggatagaactgcgggtagacgacgccgtatgctactcaaaaataacatccgtagaggcagtagccaactactccgccattcccacaactataggaggcctgaggttcgagagaagtcacgacagccagggaaaaatctccggcagcccactagacatcaccgccataaggggatcgttctccgtaaactacagaggactacgactaagtctaagtgaaataacagccacttgcacgggcgaagtcacaaacgtcagcgggtgctacagctgcatgaccggcgccaaagtttccatcaaactccattcatccaagaacagcaccgcacacgtccgatgcaaaggagacgaaacagccttctcagtcctagaaggtgtccacagctacaccgttagcttaagtttcgaccacgccgtagttgacgaacagtgccaactcaactgcggcggacacgagtcgcaagtcaccctcaaagggaacctaatcttcctcgacgtcccgaaattcgtcgacgggagctacatgcaaacataccatagcactgtgccaacaggggccaatatccctagccccacagattggctcaatgcgctattcgggaacggcctaagtagatggattctcggggtaatcggcgttctcctcggaggtcttgccctattcttcatgataatgagcctcttcaagctcgggacgaaacaggtcttccgcagccgcaccaaactcgcatag

SEQ ID NO: 16569 - RNA, 3222 nt, synthetic construct
  misc_feature 1..3222: note = derived and/or modified CDS sequence (opt11) from SFTSV/Phlebovirus(JS2010-019)__JQ317179.1__GP
  source 1..3222: mol_type = other RNA
atgatgaaggtaatctggttctcatccctaacctgcttcgtcattcaatgcagcggagactccggccccatcatctgcgcaggccctatccacagcaacaaaagcgctgacatcccccacctcctgggctacagtgagaaaatctgccaaatagacagactaatccatgtaagctcttggctccgcaaccacagccaatttcaaggatacgtcggccaacgcggaggacggagccaagtgtcctactacccggcagagaactcatactcgagatggtccgggctactgtcgccctgcgatgccgactggctcggcatgctcgtcgtaaagaaagccaagggcagcgacatgattgtacccggaccctcctacaagggcaaagtctttttcgagcgaccaacattcgatggatacgtcggttggggttgcggctccggcaagagccgaaccgagtccggagaactctgctccagcgactcaggaacaagcagcggcctgctgccgtcagaccgcgtgctatggataggggacgttgcgtgccaaccaatgacccccatacccgaagaaaccttcctagagctcaagtcattttcccaaagtgagttcccagacatatgcaagatcgacggcatcgtcttcaaccaatgtgaaggcgaaagcctcccgcagccattcgacgtagcatggatggacgtcgggcactcgcacaagatcataatgcgcgaacacaaaaccaaatgggtccaagaatcaagcagcaaagacttcgtatgctataaagaaggaaccggcccctgctcggaatcagaagaaaagacatgcaagaccagcggaagctgccgcggggacatgcagttctgcaaggtggcaggctgcgaacacggcgaagaggccagcgaagccaaatgtaggtgcagcctggtacacaaaccaggagaagtcgtagtctcatacggcggaatgagggtaaggccaaaatgctacggcttctcccggatgatggcaaccctagaagtgaaccaaccagagcaacgactaggacaatgcaccggatgccacctagaatgcataaacgggggagtgcgactgatcaccctaacaagcgaactcaaatccgccaccgtctgcgcaagccacttttgcagctcggccacctccggcaagaaaagcacagaaatacaattccacagcggctcgctcgtgggaaaaaccgccatacacgtcaaaggggcactcgtcgacggaactgagttcacattcgagggctcctgcatgtttccagacggctgcgacgccgtagactgcaccttctgccgtgagttcctcaaaaacccacaatgctatccagcaaagaaatggctattcatcatcatagtcatcctgctgggatatgcaggactaatgctcttaacgaacgtactcaaagccataggcatctgggggagttgggtaatagcccctgtcaaactaatgttcgcaataattaaaaagctgatgcgtaccgtatcctgcctcatgcgaaaactcatggacaggggcagacaagtcatacatgaagaaataggcgaaaacagagagggaaaccaagacgacgtaagaatcgagatggcaagaccgcgtcgcgtgagacactggatgtacagcccagtcatcctcaccatactcgccatcggcctagccgaatcatgcgacgaaatggtccatgccgacagcaaacttgtatcatgccgccagggatcaggaaacatgaaggagtgcgtaaccacgggcagagccctgctctccgcggtaaaccccggtcaagaagcatgcttgcacttcacagcacccggatccccagactccaaatgcctgaaaataaaggtcaagcgcatcaacctaaaatgtaagaaaagctcatcttacttcgtcccagacgcccgctcccgctgtacaagcgtgcgacgatgtaggtgggcaggagactgccaatccggatgcccaccacatttcacctcaaatagcttcagcgacgactgggcaggcaaaatggacagagccggccttggattctcgggctgctcagacggctgcggcggagccgcctgcggatgcttcaacgccgcaccaagctgcatattctggcgaaaatgggtcgaaaacccgcacggaattatatggaaagtgagcccctgtgcagcctgggtaccctcagcggtcattgaactaacaatgcccagcggggaagtcagaacgttccatccaatgtctgggatcccaacccaggtattcaaaggcgtatccgtaacctacctcggctcagacatggaagtaagcggacttacagacctatgcgaaatcgaagagttgaaaagtaagaaactcgcgctcgctccctgtaaccaagcaggaatgggagtcgtaggcaaagtcggcgaaatacaatgttcttcagaagaatcagcaagaacaataaagaaagacggctgcatctggaacgcagacctggtaggcatagaactacgagtcgacgacgcggtctgctacagcaaaatcacttcagtagaagccgtagcgaactactcagcaataccaacaactataggaggcttacgttttgaacgaagtcacgacagccaagggaaaatatcgggtagcccactcgacataacagcaataagaggctccttcagcgtcaattacagaggcctgcgcttaagcctaagcgaaatcacagcgacctgcacgggagaggtgacaaacgtgtccgggtgctacagctgcatgaccggcgccaaagtaagcataaaactgcactcatcgaaaaacagcaccgcccacgtcagatgcaaaggcgacgaaaccgcgttcagcgtcctcgaagggggtcacagctacacggtctccctctctttcgatcacgccgtggtagacgaacaatgccaactcaattgcggcggccacgagtcacaggtcaccctcaaaggcaacctcattttcctcgacgtcccaaaattcgtagatgggtcctacatgcagacctaccacagcactgtaccgaccggcgcgaacataccatcacccaccgactggctaaacgccctattcggaaacggtctatcgcgctggatactaggtgtcataggagtactcctgggcgggctagcactattcttcatgatcatgagtctattcaaactcggaacaaaacaagtatttcggagtcggacaaaactcgcctaa

SEQ ID NO: 16570 - RNA, 3222 nt, synthetic construct
  misc_feature 1..3222: note = derived and/or modified CDS sequence (opt11) from SFTSV/Phlebovirus(JS24)__HQ830164.1__GP
  source 1..3222: mol_type = other RNA
atgatgaaagtcatatggttctcatcgctgatctgcctagtcatacagtgcggcggggacacgggaccaataatatgcgcaggacctatccacagcaataaaagcgccgacataccacatctactcggatacagtgaaaagatatgccaaatagacaggctaatccacgtctcctcatggctgcgaaaccacagccagttccaaggatacgtcggacagcgcggaggcagaagccaagtatcatactaccccgcagaaaattcatacagcagatggtcaggcttacttagcccgtgcgatgcagactggctcgggatgctggtagtgaagaaagctaaaggctcggacatgatcgtaccgggtccctcatacaaaggtaaagtgttcttcgaacgcccaacgttcgacggatacgtaggatggggatgcgggtccgggaagagtcgtacagaaagtggagaactatgctcaagtgacagcgggacctcaagcggactactgccatcagaccgggtcctctggattggtgacgtagcatgccagcccatgaccccaataccggaggaaaccttcctcgaacttaagagcttttcccaaagcgagttccccgacatatgcaaaatagacgggatagtgttcaaccaatgtggcggcgaatccctcccccaaccgttcgacgtggcctggatggacgtcggacacagccacaagatcatcatgagggaacacaaaacgaagtgggtacaggaatcatccagcaaagacttcgtctgctacaaggagggcacgggaccatgcagtgaaagtgaagagaaaacatgcaagacctcaggctcctgcagaggcgacatgcaattctgtaaggtagcgggttgcgaacacggagaagaggcaagcgaagctaaatgccgctgcagcctagtccacaaacctggcgaggtagtcgtcagctatgggggcatgcgtgtgagacccaagtgttacgggttcagccgaatgatggcaaccctcgaagttaaccaacccgaacaaagaataggacaatgcactggatgccacctagaatgcatcaacggaggagtacgtctcataaccctcacaagcgaactaaagagcgccaccgtgtgtgcatcacacttctgcagctccgcaacgagtggcaagaaatcaaccgagatacaattccactcaggcagcctcgtaggcaaaacagccatccacgtcaaaggggccctcgtggacgggacagagttcaccttcgaaggatcgtgcatgttcccagacggatgcgacgctgtagactgcaccttctgcagagagttcctcaaaaacccccaatgctacccagcaaagaaatggctttttatcatcatcgtgatactcctaggatacgcaggactcatgctactgaccaacgtactcaaagcgatcggcgtctggggaagctgggtaatagcacccgtgaaactcgtattcgcaatcatcaagaagctgatgagagccgtgtcttgcctcatgggcaaactaatggaccgggggagacaggttatccacgaagaaataggtgaaaacagagaaggaaaccaagacgacgtccgcatcgaaatggcacggccccgccgggtcaggcactggatgtatagccctgtcatactaacaatactggcaataggcctggcagagggctgcgacgagatggtgcacgccgacagcaaactggtttcatgcagacaaggatccggaaacatgaaggaatgtgtaaccaccggcagggccctcctcccagcagtgaatccaggacaggaagcgtgcttacacttcaccgcacccggctcccccgattcaaaatgcctcaagatcaaagtaaagaaaataaacctaaaatgcaaaaagagctcatcatatttcgtgccagatgccagaagcagatgcacttccgtgcgaagatgccggtgggctggagactgccaaagcggatgcccgccacacttcacgagcaacagcttcagtgatgactgggcaggcaaaatggatcgagcaggtctagggttctcaggatgctccgacggatgcggaggcgctgcctgtgggtgcttcaacgcggcccccagctgcatattctggagaaagtgggtagagaacccccacggaatcatatggaaggtgagcccctgcgccgcatgggtaccctcggctgtaatcgaactaaccatgcccagcggagaagtccgcacgttccaccccatgagtggaataccaacccaagtcttcaaaggggtcagcgtgacatacttaggaagcgacatggaggtaagcggtttaaccgacctctgcgaaatagaagaactaaaatcgaaaaagctcgcgttagcaccctgtaaccaggcaggaatgggcgtcgtcggcaaggtaggcgaaatccaatgctcatcagaagagagcgcccgtaccatcaagaaagacgggtgtatatggaatgccgacctggttgggatcgagctccgggtcgacgacgcggtctgctactccaaaataacaagtgtcgaggctgtagcaaactactcggcaatccccacgacgataggagggctccggttcgaaagaagccacgacagtcaaggcaaaatatcgggctcaccactcgacataaccgcaatcagggggagcttctcggtaaactacagaggactgcgcctatccctgagcgagatcaccgcaacatgcacaggagaagtcaccaacgtctcaggatgctactcctgcatgacaggggcaaaagtgtcaattaaactacacagcagcaagaatagtacggcccacgtacgctgtaaaggggacgaaacagcgttctcggtcttggaaggagtacacagctacagcgtaagtctatcatttgaccacgccgttgtggatgaacaatgccaattaaactgcgggggccatgaatcccacgtgaccctcaaaggcaacctcatatttctggacgtaccgaaattcgtcgacggctcatacatgcaaacctaccacagcacagttccaaccggtgcaaacataccgtcgccaaccgactggctcaacgccctattcggaaacggattatcacgctggatcctaggagttataggcgtgctactaggcggcctcgcactatttttcctgataatgtccctcttcaaactgggaacgaaacaagtgttcagaagccgaacaaagctagcatga

SEQ ID NO: 16571 - RNA, 3222 nt, synthetic construct
  misc_feature 1..3222: note = derived and/or modified CDS sequence (opt11) from SFTSV/Phlebovirus(JS4/China/2010 strain JS4)__HQ141605.1__GP
  source 1..3222: mol_type = other RNA
atgatgaaggtcatatggttctcatcactaatctgcttcgtcatacaatgctcgggcgattcaggtccgatcatctgcgcaggccccatccacagcaacaaaagcgcggacatcccccacctcctagggtacagcgaaaagatatgccaaatagaccgcctaattcacgtgagcagctggctacgaaaccactcacagttccagggatacgtcggacagagaggcggccgaagccaagttagctactaccccgcagaaaacagctacagccggtggagcggcctgttatcaccctgcgacgccgactggctaggaatgctggtcgtcaaaaaggcgaaaggatcagacatgatcgtaccagggccctcttataaaggcaaagtattcttcgagcgccccacatttgatgggtacgtaggctggggctgcgggtccggcaagtcacggaccgaaagcggcgagctctgctcaagcgacagtgggacatcgtccggcctgttgccatccgacagggtactctggatcggtgatgtcgcctgtcaaccaatgacccccatacccgaggaaactttcctagaactcaagagcttctcccaatccgagttccccgacatctgcaaaattgatggaatcgtcttcaaccagtgcgagggcgaatcccttccacagcccttcgacgtcgcatggatggacgtagggcactcgcacaaaatcatcatgcgagagcacaaaacaaaatgggtacaggaatccagctccaaagacttcgtatgctacaaagaagggacaggcccctgctcagagtcagaagagaaaacctgcaaaacaagcggcagctgcaggggagatatgcagttctgcaaagtcgccggatgcgaacatggcgaagaagcctccgaagcgaaatgccgatgtagcctagtccacaagccgggcgaagtcgtagtgtcatacggaggcatgcgcgtccgaccaaaatgctacggcttctcccgaatgatggcaacactggaagtcaacccgccagaacagaggataggacaatgcacaggatgccacctggaatgcatcaacggcggcgtacgactgatcacactcaccagcgaactgaaatccgccaccgtctgcgcctcacatttttgcagtagcgcgacaagtggcaaaaagagcacagaaatccaattccacagcggaagtctagtaggaaaaaccgcaatacacgtcaaaggcgccttggtcgacggaacagagttcacctttgagggctcatgcatgtttccagatgggtgcgacgccgtggactgcaccttctgccgtgagttcctaaagaacccgcagtgctacccagcgaagaaatggctattcatcataatagtaatattactaggatatgcaggcctcatgctactaacaaatgtcttaaaagccataggcgtctggggaagctgggtcatcgctccggtaaaacttctattcgcaataataaagaaactaatgcgcacggtgtcctgcctaatgggaaaactcatggacagaggtcgccaagtaatacacgaagaaatcggagaaaaccgcgaaggaaatcaagatgacgtccggatagaaatggcacgtccaagacgggtccgccactggatgtactcaccagtcatactaacaatcctagccataggattggccgaaggatgcgatgaaatggtccatgccgactcgaaactcgtgagctgccgccagggctcagaaaatatgaaagaatgcgtgaccacagggcgcgcgctactaccagcggtcaaccccggacaagaagcctgcctccacttcactgcccccgggagccccgactcaaaatgcctcaagatcaaggtgaaacgaatcaacctaaaatgcaagaaatccagcagctatttcgttcccgatgcacgatcacgctgcacctcagtccgccggtgtaggtgggcaggggactgccaaagtggatgcccaccacacttcacgtccaactcatttagcgacgactgggccggcaaaatggaccgagccgggctggggttctcaggatgcagcgacggctgcggcggcgccgcatgcggatgcttcaatgcagcaccgtcctgcatcttctggcgcaaatgggtcgagaacccacatgggataatatggaaagtatctccctgcgcagcctgggtcccctcggccgtgatagaacttacgatgccctctggagaagttcgcacgttccacccgatgtcaggcatcccgacgcaagtctttaaaggcgtatcggtcacctacctcggctccgacatggaggtcagcggcctcacagatttatgcgaaatagaggaactaaaatcaaagaaactagcactcgccccctgcaaccaagccggaatgggggtagtaggcaaagtcggcgaaatacaatgctcctcagaagaatcagcacgcacaatcaaaaaggacggctgcatctggaatgccgatctagtaggcatagagctccgagtcgacgatgcagtctgttacagcaaaataaccagcgtcgaagccgtcgcaaactactcagccatcccaaccacaattggcgggctccgattcgaaaggtcacacgacagccaggggaagatcagtggttcacccctagacataaccgcgatacgcggctcattctccgtcaattaccgaggcctgcgcctaagcctatccgaaataacagccacatgcacaggggaagttaccaatgtcagcggatgctactcgtgcatgaccggggcaaaggtctcaatcaaactacatagctccaagaacagcacggcacatgtaagatgcaaaggagacgaaacagcgttttccgtcctcgaaggcgtccatagctacacggtgagcctatcattcgaccatgcagtggtagacgagcaatgccagctcaactgcggcggccacgaatcacaagtgacactgaaaggcaacctgatattccttgacgtcccgaagttcgtggacgggagctacatgcagacgtaccacagcaccgtaccaaccggagccaacataccctccccgaccgactggctaaatgccctattcggcaatggactaagccgatggatcctgggagtaataggcgtcctcctcggaggccttgcccttttcttcctcataatgagcttgttcaaactagggacaaaacaagtattccgatcccgaacaaaactcgcatag

SEQ ID NO: 16572 - RNA, 3222 nt, synthetic construct
  misc_feature 1..3222: note = derived and/or modified CDS sequence (opt11) from SFTSV/Phlebovirus(JS6)__HQ830170.1__GP
  source 1..3222: mol_type = other RNA
atgatgaaagttatctggttcagctcgctcatctgcctagtaatccaatgcggcggggacacgggcccaataatatgcgctggacccatccacagcaacaaatcagcagacatcccgcacttgttaggatactcagaaaagatctgtcagatcgatcgcctgatacacgtcagctcgtggctgcgaaaccactctcaattccagggctacgtaggccaacgaggagggaggagccaagtctcctactacccggcggaaaactcctactcaagatggtcaggtcttctctcgccatgcgacgccgactggctcgggatgctggtcgttaaaaaggcaaaggggagcgacatgatagtccccggccccagttacaaaggcaaagtgttcttcgaacgccccacattcgacggatacgtaggctggggctgcggatccggaaaaagcagaacagaaagcggcgagctctgcagctcagacagcggcacaagcagcggcctcctgcccagcgacagggtcctatggataggcgatgtggcttgccaacccatgacaccaatccccgaggagacctttctagagctgaaaagtttctctcagtccgagttccccgacatatgcaaaatagacggtatagtattcaaccagtgcgaaggagaatccctcccacaacccttcgacgtcgcgtggatggacgtcggacacagccacaagattatcatgcgggaacacaaaacgaagtgggtccaagaaagcagcagcaaggatttcgtctgctacaaagaaggaacagggccatgtagcgaaagcgaagagaaaacctgcaaaacctccgggagctgtaggggagacatgcaattctgcaaagtcgcaggctgcgaacacggagaagaagcatccgaagccaaatgcagatgctccttagtccacaaaccaggagaagtcgtagtatcgtatggaggaatgcgtgtgcgcccgaagtgctacggattctcgagaatgatggcgacactagaggtaaatgaaccagagcaaagaataggacaatgcaccggatgccaactagagtgcatcaacggtggcgtacgactaataacactaaccagcgagcttaaaagcgcgaccgtatgtgcgtcccacttctgctcctcagccacatccggcaagaaaagcacagaaatacaattccacagcgggtcactcgtaggaaaaacggccatacacgtcaaaggcgcgctagtggacggcacagagttcacgttcgaaggctcctgcatgttcccagacgggtgcgacgccgttgactgtaccttctgtagagagttcttaaagaacccgcagtgctatccggccaaaaagtggctattcataataatagtaatactactcggatacgcaggcctaatgctcctcacaaacgtacttaaagcaataggcgtatggggcagctgggtcatagcgcccgtaaaattagtcttcgcgataatcaagaagctcatgcgcgccgtatcatgcctaatggggaaattaatggaccggggaagacaagtcatacacgaagaaataggagaaaacagggaaggcaaccaagacgatgtcagaatcgaaatggcacgacctagacgcgtaagacactggatgtacagcccagtcatactcacgatactggcaatgggactggctgaaggctgcgatgagatggtgcacgccgacagcaaactcgtaagctgcagacaaggcagcggcaacatgaaagaatgcgtaacaacaggtcgggccctcctccccgccgtaaacccaggacaggaggcctgcctacactttaccgcacccgggagtccagacagcaaatgcttaaaaataaaggtcaagaggataaacctcaaatgcaagaaaagctcatcctacttcgtccccgacgcacgatcaagatgtacatcagtaagacgctgccgatgggcgggagattgccagtccggatgtcccccgcatttcacgtccaacagcttttccgacgactgggccggaaaaatggacagagcaggtctcggcttctcaggctgctccgacggttgcggcggagcagcctgtggctgtttcaatgccgccccaagctgcatcttttggcggaaatgggtcgaaaatccgcacggaataatctggaaagtctcaccgtgcgccgcatgggtaccctcagcagtaatcgagctaaccatgccaagcggggaggtgcgcacattccacccgatgtcaggaataccgacacaggtattcaagggtgtatccgtaacctacctcggcagcgacatggaagtgtccggactaacggatctctgtgaaattgaagaactaaaatccaaaaagctcgcactcgccccctgcaaccaagccggaatgggggtcgtaggaaaagtcggagaaatccagtgttcatccgaagagagtgcacgaacgatcaagaaggacggctgcatctggaacgccgacctggtcggaatcgaactcagggtcgacgacgcggtctgctactcaaagatcacgtccgtcgaagcagtagccaactacagcgcaatcccaacaacaatcggaggcctccgctttgaaagaagccacgacagtcaaggcaaaatatcaggatcaccactagacataacagccatccgaggatcgttcagcatcaactaccggggcctaagactaagcctatccgaaattacagctacctgcaccggcgaagttacaaacgtctcgggatgctacagttgcatgaccggcgcaaaagtgagtataaaactgcacagctccaaaaactccaccgcacacgtacgatgcaagggagacgaaacagcatttagcgtgctagaaggcgtacacagctacagcgtcagcctctccttcgaccacgccgtcgtcgacgaacagtgccaactaaactgcgggggccacgaatcacaagtaacactacgcggtaacctaattttcctggacgtcccgaaattcgtagacggctcatacatgcagacgtaccacagcacagtcccaactggcgcgaacatcccatcccccacggactggctaaacgcactcttcggaaacggactgagccggtggatactgggcgtcataggcgttctcctaggaggcctcgcgcttttcttcctgataatgtccctattcaaactgggaaccaaacaagtctttagaagccgcaccaagctggcataa

SEQ ID NO: 16573 - RNA, 3222 nt, synthetic construct
  misc_feature 1..3222: note = derived and/or modified CDS sequence (opt11) from SFTSV/Phlebovirus(JSD1)__JF267784.1__GP
  source 1..3222: mol_type = other RNA
atgatgaaggtgatctggttctcctccctcatctgcttcgtaatccaatgcagcggggactctggacccatcatctgcgcgggacccatccacagtaacaaaagtgccgacataccacacctactagggtactctgagaaaatatgccaaatagaccgactgatccacgtgtcgagttggctccgcaaccacagccaatttcaaggctatgtgggccaacgaggaggaagatcccaagtcagctactacccagcggaaaactcacacagtagatggagcggcctactatccccctgcgacgcggactggctcggcatgttggtcgtcaaaaaggccaagggatccgacatgatagtcccgggaccctcgtacaagggaaaggtcttcttcgaacgcccaaccttcgacggctacgtaggatggggatgcggatccgggaaatccagaacagagagcggagaactatgctcaagcgacagcggtacatcaagcggcctactaccctctgatagagtactttggataggcgacgtggcatgccagcccatgacaccaatcccggaagaaacttttctcgaactgaaatcgttcagccagagcgagttcccggacatctgtaaaatagacggcatagtcttcaatcaatgcgaaggtgaaagcctcccacagcccttcgacgtcgcatggatggacgtcggccacagccacaaaatcattatgcgcgagcacaaaacaaaatgggtacaggaaagttctagcaaagacttcgtatgctacaaagaaggcaccggcccatgctcagaaagtgaagagaaaacctgtaaaacatccggctcctgccggggagacatgcaattttgcaaggtcgccggatgcgaacatggagaagaagcctctgaagcaaagtgccgatgtagcttggtccacaaaccgggcgaagtagtcgtttcatacggaggcatgcgagtacgtcccaaatgctacggattctcccgcatgatggccacccttgaagtaaatcaacccgaacaacgaataggacaatgcaccggttgccacctagagtgcatcaacggaggcgtccgcttaataaccctaacttccgagctaaaaagcgcaactgtatgcgcctcccacttctgtagctcagccacctccggaaagaaaagcactgaaatccaattccactctggctccttagtcggcaagacggccatacacgtcaaaggcgccctggtagacgggacagaatttacgttcgaagggtcatgcatgttcccagacggatgcaacgcggtagactgcaccttctgccgcgagttcctgaagaacccgcaatgctacccagccaagaaatggcttttcataattatcgtaatactccttgggtacgcaggattaatgctcctaacgaacgtgctcaaagcaataggaatatggggcagctgggtaatcgccccagtaaaactcatgttcgccataataaagaaactcatgagaaccgtaagctgcctaatgggcaaacttatggacagaggcagacaagtcatacacgaagaaatcggcgaaaaccgtgaggggaaccaggacgacgtccggatagagatggcacggccgcgtcgagtacggcactggatgtatagcccagtaatcctaaccttcctcgctataggtctagccgagagctgcgatgaaatggtacacgccgactcaaaattagtatcatgcagacaaggcagtggcaacatgaaagagtgcgtgaccacaggccgggcactcctacccgcagtaaaccccgggcaggaggcatgcttacacttcaccgcacccgggagtccagactcaaaatgcctcaaaataaaagtcaaacgaatcaacctcaaatgcaagaaaagctcatcctacttcgtacccgacgcccgaagtaggtgcacaagcgtcagaagatgccgctgggcaggcgactgccagagcggatgtcccccgcacttcacatcgaacagcttcagcgacgactgggcgggaaaaatggacagagccggccttggcttctcaggctgctccgacggctgcggaggagcggcatgcggttgcttcaatgcagcccccagctgcatattctggagaaaatgggtcgaaaacccacacggaataatatggaaagtctccccatgcgctgcctgggtcccctcagcggtcatcgaactcacaatgccatccggggaagtccgcacattccaccccatgtcaggcatcccaacgcaagtcttcaaaggcgtctcggtcacctacctaggctccgacatggaagtatccgggcttacggacctctgcgagatagaggaactcaaatcgaagaaactagccctagcgccctgcaaccaagccggaatgggagtagtgggaaaagtaggagaaatccaatgctccagtgaagaaagcgcacgaaccatcaagaaagacggctgcatatggaacgcagacctcgtcggaatcgaactccgcgtcgatgacgccgtgtgctactccaaaattacatcagtggaagcagtagcaaactactcagccattcccacaaccatcggaggcctcagattcgagagatcccacgacagccagggcaaaataagtggttcacccttagacataacagcgatccgggggagtttttccgtcaactaccggggactaagactaagcctcagcgaaatcacagccacatgcacgggcgaggtaacaaacgtaagcggctgctattcatgcatgaccggggccaaagtcagcataaaattacattcgagtaaaaattccaccgcacacgtgcgttgcaaaggggacgagacagcattctcggtactagaaggcgtccacagctacacagtgagcctatctttcgaccacgcggtcgtagacgaacaatgccaactcaattgcggcggacatgaatcccaagtgaccctgaaaggcaacctaatcttcctcgacgtaccaaaatttgtagacggatcatacatgcaaacttaccatagcaccgtcccaaccggcgcaaacatcccgagccccaccgactggctgaacgcccttttcggcaacggcctgtcccgctggatcctaggagtaatcggcgtactcctgggagggctcgccctcttcttcatgataatgagcctgttcaaacttggtaccaaacaagtcttcaggtcacgcaccaaactagcataa

SEQ ID NO: 16574 - RNA, 3222 nt, synthetic construct
  misc_feature 1..3222: note = derived and/or modified CDS sequence (opt11) from SFTSV/Phlebovirus(LN2/China/2010 strain LN2)__HQ141608.1__GP
  source 1..3222: mol_type = other RNA
atgatgaaagtgatatggttcagctccctcatctgctttgtaatccagtgcagcggggacagcggacccataatctgcgcaggtcccatacacagcaacaaatcagccgacatcccacatctgctaggatactctgagaaaatctgccaaatagaccgactcatacatgtatccagctggctcagaaaccattcccagttccagggatatgtcggccagcgcggaggccgaagccaggtcagctactatccggccgaaaactcctacagccggtggtcgggcctcctatcaccatgtgacgccgactggcttggcatgctagtggtaaagaaagcaaaaggctccgacatgatagtacccggcccaagctacaagggaaaagtgttcttcgaacgccccacgttcgacggctacgtgggctggggctgcggcagcggaaaaagcaggaccgaaagcggtgaactatgcagtagcgactcaggaacgtcgtccggccttctacccagcgaccgcgtactctggatcggggacgtcgcctgccagcccatgacaccaatacccgaggaaacgtttctggaactaaagagcttctcacaatccgagttcccagacatctgccgaatagacggcatcgtgtttaatcaatgtgagggtgagagtctgccgcaaccattcgatgtagcatggatggacgtaggacactcgcacaaaattataatgagagaacacaagacgaaatgggtccaagagtcaagttccaaagacttcgtatgttataaagaaggcacgggcccatgcagcgaaagcgaggagaaaacctgcaaaacatccggatcatgtcgaggagatatgcaattctgcaaagtagcgggctgcgaacacggtgaagaagcgagcgaagccaaatgccgatgctcgctcgtgcacaagccaggggaagtcgtcgtttcctacggaggcatgcgcgtccgaccgaaatgctacggattctcaaggatgatggcgacactggaagtcaaccaacccgtccaaagaataggccaatgcacaggctgccacctcgagtgcataaatggaggagtcaggctcataacccttaccagcgaactcaaatccgccaccgtatgcgccagccacttttgctcgagcgccacatcgggaaagaaatccacagaaatacagttccacagtggaagtctcgtgggcaaaaccgccatacacgttaaaggtgccctagtcgacggaactgaatttacattcgaaggatcgtgcatgttcccggacggctgcgacgcggtggactgcaccttctgcagagagttcctcaaaaacccccagtgctaccccgcaaagaaatggctattcataataatcgtcatactcctgggctacgcagggctcatgctgctgaccaacgtcctaaaagccataggcatctggggcagctgggtcatagcaccagtcaaactcatattcgcaataataaagaaactcatgagaaccgtctcatgcctaatgggaaaactaatggacagaggaagacaagtaatacacgaagaaatcggcgagaaccgagaaggaaaccaagacgacgtcagaatagagatggcgcgaccccgacgggtccggcactggatgtacgcaccggtaattctcacgatactagcaatgggcctagcggaaagctgcgacgagatggtacacgccgacagcaaactcgtatcctgccgccaaggcagtggcaacatgaaagaatgcgtcacaacgggccgcgccctactcccggccgtcaatcccggacaagaagcctgcctacacttcacagcaccggggtcccccgacagtaaatgcctgaaaattaaagtcaaacgcatcaaccttaagtgcaagaagagttcatcatacttcgtaccagacgcccgcagccggtgcacaagcgtacgtagatgccgctgggccggagactgccagtcaggatgtccgccccatttcacaagcaactcattcagcgacgactgggcaggaaagatggacagagcgggactagggttcagcggctgctcagacggctgcggaggagccgcgtgcggctgcttcaatgccgcgccatcctgcatattctggcgcaaatgggtcgagaacccccacggaataatctggaaagtatcaccttgcgccgcctgggtaccaagcgcggtgatcgagctgaccatgccgtccggggaagtaagaaccttccaccccatgtcagggataccgacgcaggtcttcaaaggagtgagcgtaacatacctagggtcagacatggaagtcagcggtctaacggacctctgcgaaattgaagaactaaagtcaaagaaactagcactggccccgtgtaatcaagcaggcatgggagtcgtaggcaaagtcggtgaaatacaatgttcgagcgaagagagcgcccgcaccataaagaaagacggctgcatatggaacgcggacctagtcggaatcgagctaagagtcgacgacgcagtctgctactccaaaatcacctctgtggaagcagtggcaaactactcagcaatacccacaaccataggaggattgcgcttcgaaagatcgcacgacagtcaaggaaaaatcagcgggtcacccctcgacatcacggccatcagggggagcttctcagtaaactataggggcctacgactgagcttaagcgaaataacagccacatgcactggcgaagtcaccaacgtgagcggatgctacagctgcatgactggagccaaagttagcataaaactgcactcaagcaaaaacagcacagcccacgtacgctgcaaaggcgatgagacagcgttctcagtgctagagggagtacactcctacaccgtcagcctcagcttcgaccacgctgtggtggacgagcaatgccagcttaactgcggcggacacgaatcccaagtgacattaaaaggcaacctaatattcctagacgtcccgaagtttgtagatggcagctacatgcaaacctatcactccaccgtccccaccggggcaaacataccatcacctacagactggctcaatgccctattcggcaacgggctgagtcgatggatattaggcgtcataggcgtactgttaggcgggctcgccctcttcttcatgatcatgagcctgttcaaactagggacaaagcaagtttttagaagcagaaccaaactggcgtag

SEQ ID NO: 16575 - RNA, 3222 nt, synthetic construct
  misc_feature 1..3222: note = derived and/or modified CDS sequence (opt11) from SFTSV/Phlebovirus(LN3/China/2010 strain LN3)__HQ141611.1__GP
  source 1..3222: mol_type = other RNA
atgatgaaagtcatttggttcagttcgctcatctgcctagtaatacaatgcggaggggacaccggacccatcatatgcgcgggccctattcactccaataagtcagcggatatcccgcacctactaggatacagcgaaaagatttgccagatcgaccgactcatacacgtgagctcatggctccgcaaccacagccaattccaagggtacgtaggccagcggggagggaggagccaggtctcatactatcctgcagagaacagctatagccgatggtcaggtctcttaagtccctgcgacgcggactggctcgggatgctggtcgtaaagaaagcaaagggcagtgacatgatcgtaccagggccatcctacaaaggcaaagtattcttcgaacggccaaccttcgacgggtacgtaggatggggatgcggatccggcaaaagtagaaccgaaagcggtgaactctgcagcagcgacagcggtacaagcagcggcctcctgccatccgaccgagtcctgtggatcggtgacgtcgcatgccaaccaatgaccccaatcccagaagaaaccttcctagaactgaaatccttcagccaatcagaatttccagacatttgcaagatagacggcatagtgttcaaccagtgtgagggcgagagtttgcctcaaccatttgacgtagcgtggatggacgtaggacactcacacaagatcatcatgagagaacacaaaacaaagtgggtacaggagtcatcctcgaaagatttcgtatgctataaagagggaacgggaccgtgctccgagtcagaagagaaaacgtgcaaaacatccggctcgtgccgaggagacatgcaattctgcaaagtagccgggtgcgaacacggagaagaagcatctgaagccaaatgccgatgctccctggtccacaaacccggcgaagtggtcgtcagctatgggggcatgcgcgtccgcccgaaatgctacggcttttcaagaatgatggcgacactcgaagtgaaccaaccagaacaacggataggccagtgcaccgggtgccacctagaatgcatcaatggaggcgtaagactgatcacactaaccagcgaactcaaatcagcaacggtctgcgcaagccacttctgcagtagcgccacatcaggaaagaaaagtacggaaatccaattccacagcggctcactcgtcggaaaaaccgccatacatgtcaaaggcgccctcgtagacggaacagagttcacattcgagggctcatgtatgttcccggatggatgcgacgcggtcgactgcacattctgccgggagttcctgaaaaacccccaatgctatccagctaagaaatggctatttatcatcatcgtaatcctgctaggctacgcgggactaatgctactcacgaacgtgctgaaagccatcggcgtctggggatcctgggtaatagctccggtcaaattggtgttcgcgatcataaagaaacttatgcgggccgtatcgtgcttaatgggaaaattaatggatcgcggacgccaagtcatccacgaggaaatcggagaaaaccgagaagggaaccaggacgacgtaagaattgaaatggcaagaccaagaagagtcagacactggatgtactccccggtgatactcacgatcttggcaatcggcctggcagaaggatgcgacgagatggtgcacgcggactcgcgcttggtaagctgcagacaagggagtggcaacatgaaagaatgcgtgacgacagggagagcactactaccagctgtaaacccaggccaagaagcgtgcctacactttacagcgcctggaagcccagactcgaaatgtctcaaaatcaaggtcaaacgaataaatctcaagtgcaagaaaagttcaagctacttcgtacccgacgcccgctccaggtgcaccagtgtgagacgatgccgatgggcgggcgactgccagagcgggtgcccaccccacttcacaagcaacagcttcagcgacgactgggcgggaaaaatggacagggcaggactagggttctcaggatgctcagacggatgcggaggagccgcttgcggatgctttaacgcagccccaagctgcatattctggcggaaatgggtcgaaaatccgcacgggatcatctggaaagtctccccatgcgctgcgtgggtaccctcggccgtgatagaactaaccatgccctcaggagaagtaaggacattccatcccatgtccgggataccgacccaagtcttcaagggcgtatcagtaacgtacctcggcagtgacatggaagtgtccggactcacagacctatgcgaaatcgaagaattaaagagtaagaagctcgccctagccccctgcaaccaagccgggatgggggtggttggcaaagtaggcgagatccagtgtagcagcgaagagagcgcccgcacaattaaaaaggacggttgtatatggaacgcagacctagttggaatcgaactcagagtagacgacgcggtctgctactcgaaaataacctcagtcgaggccgtagccaactactcagcaattcccaccacaataggaggactaaggttcgagcgctctcacgacagccaaggaaaaattagcggcagccccctagacatcaccgccatcagaggcagcttcagcgtcaattacaggggtctccgactcagtctaagcgaaataacggcgacatgcactggagaagtaacgaacgtgtccgggtgctacagttgtatgaccggcgccaaagtctcaattaaacttcattcgtccaaaaactcaacagcccacgtacggtgtaaaggggacgaaacagctttcagcgtcctggaaggggtccatagctacagcgtatcactgagcttcgaccacgccgtcgtcgacgagcaatgccaactaaactgcggaggtcacgaatcacacgtaacactacgcggaaacctaatcttcttagacgtgccaaaattcgtcgacggctcctacatgcaaacgtaccacagcacggtacccaccggggcgaacatcccgagcccaaccgactggctgaacgccctctttggaaacggactaagccgatggatactcggagtgataggcgtactccttggagggcttgccctattcttcttaataatgagcctattcaaactcgggaccaaacaagtatttaggtcacgaaccaaactcgcctaa

SEQ ID NO: 16576 - RNA, 3222 nt, synthetic construct
  misc_feature 1..3222: note = derived and/or modified CDS sequence (opt11) from SFTSV/Phlebovirus(SD24/China/2010 strain SD24)__HM802201.1__GP
  source 1..3222: mol_type = other RNA
atgatgaaagtcatctggttcagcagcctcatctgcctggtaatacagtgctccggagactccggcccaataatctgcgccggaccaatccacagcaacaaatcagctggaataccccacctgttaggctactccgagaaaatatgccagatcgaccgcctaatacacgtctcatcatggctacgtaaccacagccaattccaggggtacgtcggccaacgcgggggccgcagtcaagtatcctactaccccgcagaaaacagctattcaagatggtcagggctactatcaccctgcgacgcggactggctcggaatgttggtcgtcaagaaggccaaggaaagtgacatgatagtaccaggtcccagctacaaaggcaaggtcttctttgaaagacccaccttcgacgggtacgtcggctggggctgcggatcagggaaatcgagaaccgaaagcggggaattatgctcaagcgacagtggaaccagcagtgggctactaccaagcgaccgagttttgtggataggtgacgtcgcatgccaaccgatgacccccatcccggaagaaacattcctcgaactcaagagctttagccagagtgagttcccagacatatgcaagatagacggaatcgtattcaaccaatgtgaaggagagtccctaccacagccgttcgacatcgcatggatggacgtcggccactcgcacaaaatcatcatgcgagaacacaaaacaaaatgggtgcaggagagcagctcgaaagacttcgtatgctacaaagagggcacgggcccctgctccgagtcagaagaaaaagcatgtaagacatccgggagctgccgaggggatatgcaattctgcaaagtagcaggatgcgaacatggcgaagaagcaagcgaagcaaaatgccgatgcagcctcgtccacaagcccggagaggtcgtggtctcatacggaggaatgcgagtgcgaccaaaatgctacggcttctccagaatgatggccaccctggaggtaaacccgcccgaacaaagaattggccaatgcacagggtgccacctagagtgcataaacggaggtgtccgattaataacccttacaagtgagctccgatccgcaacagtctgcgcgagccacttctgctcctcagccacaagcggaaagaaaagcacagaaatacacttccactcaggatccctagtaggaaaaaccgccatacatgtaaagggagccctggtcgacggaacagagttcacctttgaaggctcatgcatgttccctgacggatgcgacgcagtagactgcaccttctgccgagagttcctcaaaaatccacagtgctacccggccaaaaagtggctattcattatcatagtcatattactgggatacgcaggcctaatgctcctcaccaacgtcctaaaagccataggcgtgtggggatcctgggtgatagcgccagtcaagctcatgttcgctatcatcaaaaagctcatgcgcacggtaagctgcttggtcggtaaactgatggaccgcggccgacaagtaatacacgaagagatcggcgaaaacggcgagggaaaccaggacgacgtccgcatcgaaatggccaggccgaggcgcgtccgccactggatgtacagtccagtaatactcacaattctagccatcggactagccgaaggctgcgacgagatggtacacgcagacagcaagctcgtaagctgccgacaaggatcaggcaacatgaaggaatgtataaccaccggcagagcgctcctcccagcagtgaacccaggacaggaagcatgcctccactttacggcacccggcagtccagactcgaaatgcctgaaaataaaggtaaaacgaatcaacctgaaatgcaagaaatcctcctcatacttcgttcccgacgccagatctcggtgcacaagcgtccgccgctgtaggtgggcgggagactgccagagcggatgtcccccgcatttcacttcaaacagcttctcagacgactgggccggcaaaatggatcgcgccgggctcggatttagcgggtgctcagacggatgcggcggtgcagcatgcggatgcttcaacgcggccccatcatgcatattctggcgcaaatgggtagagaatccacacggaataatatggaaagtatccccgtgcgcagcctgggtcccatctgccgtgatcgagctcacaatgccgagcggcgaagtacgcaccttccaccccatgtcaggaataccgacacaggtattcaaaggagtttccgtcacatacctcgggagcgatatggaagtgagcggactaacagacctatgcgagatcgaagaactcaagagtaagaaactcgcactagcaccatgcaaccaggcaggcatgggcgtcgtaggcaaagtaggggagatacaatgctcatcggaggaaagcgccagaaccatcaagaaagacgggtgcatttggaacgcagacctcgtaggaatcgaactacgagtcgacgacgccgtatgctactcgaaaataacctccgtcgaggcggtagcaaactacagcgcaatacccacaacaatcggtggactacggttcgagcgtagccacgattcccaaggaaaaatctcaggaagcccactcgacatcaccgcaatccgcggaagtttcagtgtcaactacagaggcctcagactgagcctatcagaaatcacagcaacctgcacgggagaagtaaccaatgtatcaggatgctatagctgcatgaccggcgccaaagtatccataaaactccactcatccaaaaactccacagcccacgttagatgcaaaggcgacgaaacagcattctccgtcctagaaggggtacatagctacatcgtctccctcagcttcgaccacgcggtagtggacgaacaatgccagctcaactgtgggggccatgagagccaagtaaccctaaagggcaacctgatattcctagacgtccccaaattcgtcgacggctcatacatgcaaacgtaccacagtaccgtccccacgggagctaatataccttcaccgaccgactggttaaacgcgctttttggaaacggcctcagtagatggatattgggagtaataggcgtactactgggaggccttgccctcttcttcctgatcatgtttctactgaagctcgggacaaaacaagttttccggagccgaacgaaacttgcatga

SEQ ID NO: 16577 - RNA, 3222 nt, synthetic construct
  misc_feature 1..3222: note = derived and/or modified CDS sequence (opt11) from SFTSV/Phlebovirus(SD4/China/2010 strain SD4)__HM802203.1__GP
  source 1..3222: mol_type = other RNA
atgatgaaagttatctggttctcctccctcatctgcttcgttatacaatgctccggcgactccggcccaatcatatgtgcaggccccattcattccaacaagtctgcagacatcccccatctgctcggctactccgaaaagatctgccaaatcgaccgattaatacacgtctccagctggctccggaaccattcccaatttcaaggatatgtaggccaacgcgggggtcgatcacaagtatcctactaccccgccgagaactcctacagcagatggtcaggactcctatcaccctgcgacgccgactggctcggcatgctcgtcgtaaagaaagccaagggaagcgacatgatagtacccggacccagctacaagggaaaagtcttcttcgagcgacccacatttgacggttacgtcggatgggggtgcggctcgggaaaaagccgaactgaatccggcgagctatgctcatccgactccggaacaagctccggcctcctcccctcggaccgagtactatggatcggtgacgtcgcatgccaacccatgacccccatcccagaagagaccttcctggaactcaagtccttctcacaatcagagttcccagacatatgcaaaatagacggcattgtcttcaaccaatgcgaaggcgagtcgctaccccaacccttcgacgttgcgtggatggacgttggacactctcataaaattatcatgcgcgagcacaagaccaaatgggtccaagaatcaagctcaaaggacttcgtatgctacaaagaaggcaccggcccatgctcggaatcagaagagaaaacatgcaaaacctctggctcatgccgaggcgacatgcaattctgtaaagttgccggatgcgaacacggtgaagaagcctccgaggcgaaatgccgctgctcccttgtccacaagccaggagaagtagtcgtctcctacggagggatgcgggttcgcccgaaatgttacggattttcgcgaatgatggccacactcgaggtgaacccacccgagcaacgtataggccaatgcacaggatgccacctcgagtgcattaatggtggcgtacgtctcatcaccctaaccagcgagctcaaatccgccaccgtatgcgccagtcacttctgttcttccgccaccagtggcaagaaatccaccgaaatccaattccactcaggctccctagtcggcaaaaccgcaatccatgtaaaaggggccctagtggatggcaccgagttcacatttgaaggatcttgcatgtttcctgacggatgcgacgccgtcgactgcaccttctgccgcgagttcctgaaaaatccacaatgctacccggccaagaaatggctattcataattatagtaattctccttggatacgccggactcatgctgctcactaacgttctcaaagcaatcggagtctggggctcttgggtcattgcgccagtcaaactactcttcgctataatcaaaaagctcatgcgcacggtttcctgcctaatggggaaactgatggaccgcggccgccaagtaatacacgaagaaataggagaaaacagagaaggcaaccaggacgacgtacgcattgaaatggcgcgcccccgccgagtccgacactggatgtactcaccagtcatactcactattctggctacagggcttgccgaaggctgcgacgagatggttcacgcagattcaaagctcgtctcgtgccgccaagggtccggaaacatgaaagaatgcgtaacaacgggacgggccctcctacctgccgtgaacccgggacaagaagcctgcctccacttcaccgcgccaggatcccccgactcaaaatgcctcaaaatcaaggtaaaacgcatcaacctaaagtgcaagaaatcaagcagctacttcgtacccgacgcacgttcgaggtgcacgagcgtgcgcagatgccgctgggcaggcgactgccagtcaggatgccctccacactttacctctaacagcttcagcgacgactgggccggaaagatggaccgcgcaggccttggcttctccggctgtagcgacggatgcggcggggccgcatgcggctgcttcaatgcggctcccagctgcatattctggagaaaatgggtcgaaaacccgcatggaatcatttggaaagtatcaccctgcgccacgtgggtacccagcgcagtaatcgagctcacgatgccttcaggcgaagtgagaaccttccaccccatgtcaggaatcccaacacaagtcttcaagggcgtttcggtaacctaccttgggagcgacatggaggtctcaggcctaacagacctctgcgagatcgaggaactcaaatccaaaaagctagccctcgcgccgtgcaaccaggccggcatgggcgtaatcgggaaagtcggtgaaatacaatgcagtagcgaagaatcagccagaaccatcaagaaagacggctgcatctggaacgcagacctagtcggaatagaactaagagtcgacgacgctgtctgctactctaaaatcacatcagtcgaggctgtcgctaactactccgccataccaactaccatagggggactgcgattcgagcgctcacacgacagccagggcaaaatctccggatcaccccttgacatcacggccatcagaggcagcttttcagtcaactaccgcggactcaggctatccctgtcagaaatcaccgctacgtgtacaggcgaagtcacgaacgttagcggctgttactcatgcatgacgggcgccaaagtcagtataaaactccactccagcaagaactccacagcccacgtacgatgcaaaggagacgaaaccgcattctccgtactcgaaggagtccactcgtacacagtatcactatctttcgaccacgccgtcgtcgacgaacaatgccaactcaactgcggaggccacgaaagccaggtaaccctgaagggcaacctaatattcctagacgtaccaaaattcgtagatggcagctacatgcaaacctatcactcaaccgtccctaccggcgccaatataccgagcccaacagactggctaaacgccctctttggcaatggactctcccgctggattctcggtgtaatcggggtcctattaggaggcctcgccctcttctttctaattatgtccctattcaagctcggcacaaaacaggtgttccgtagccggacaaagttagcctaa

SEQ ID NO: 16578 - RNA, 3222 nt, synthetic construct
  misc_feature 1..3222: note = derived and/or modified CDS sequence (opt11) from SFTSV/Phlebovirus(SDYY104/China/2011)__KU239112.1__GP
  source 1..3222: mol_type = other RNA
atgatgaaagtcatctggttcagtagtctgatatgtctggtcatacagtgctctggagactccggacccatcatctgcgcaggccccatccactccaacaaaagcgcgggcatcccccacctactaggatacagcgagaaaatctgccaaatcgacaggctcatacatgtgtcctcctggctacgaaaccactcacagttccaaggttatgtaggccagcgcggagggcgaagccaggtctcctactaccccgctgaaaacagctacagcagatggagcgggctactatcgccctgcgacgccgactggctcggaatgctagtcgtaaagaaagcaaaagaatccgacatgatcgtaccagggcctagctacaagggtaaagtcttcttcgagagaccgacattcgatgggtatgtcggctggggctgcggatcaggaaagagccgcacagaaagcggtgaattatgctcaagtgactccggcacatcatcaggactgctgccatccgaccgggtcctatggataggcgacgtcgcatgccagcccatgacccccataccggaagaaacattcctggaactcaactccttcagccaatcagagttcccagacatatgcaagatagacggcatcgtattcaaccaatgcgaaggagaaagcctgccccaaccattcgacgttgcatggatggacgttggacactcccacaaaatcataatgagagaacacaaaactaaatgggtccaggaatccagctcaaaagacttcgtatgctacaaagagggcaccggcccatgctcagaatcagaagagaaagcctgcaaaacctccggcagctgccggggagacatgcaattctgcaaggtggcaggctgcgaacacggagaggaagcctctgaagccaaatgccgctgttccctcgtccacaaacccggcgaagtagtagtcagctacggaggcatgcgagtcagacccaagtgctacggtttctcacgcatgatggccacgctggaagttaacccacctgaacaacgcataggacaatgcacgggatgccacctcgaatgcataaacggcggcgtacgactcataacgttaaccagcgaacttcgcagcgcgacagtatgcgcatcccatttttgcagctcggccacaagcggcaagaaaagcacggaaatccacttccactcaggatcactcgtaggaaaaacagcgattcacgtaaaaggtgcgttagtcgacggcaccgagttcacattcgaaggctcctgcatgttcccggacgggtgcgacgcagtagactgtacattttgccgagagttccttaaaaacccgcaatgctaccccgctaagaaatggctgttcataatcatagtaatcctcctcgggtacgcgggactcatgctcctcacgaacgtcctaaaggcaataggcgtgtgggggagctgggtaatagccccggtcaaactaatgtttgccatcatcaagaaactcatgcgcaccgtcagctgcctggtgggcaaactaatggaccgcgggcgacaagtaatacacgaagaaataggcgaaaacggagaaggtaaccaagatgatgtaaggatagagatggcgaggccccggagagttagacactggatgtacagccccgtcatcctcacaatcttggccatcgggctagccgaaggctgcgacgaaatggtccacgcggacagcaaactcgtctcttgccggcaagggagcggcaacatgaaagagtgcatcacaacaggacgcgccttgttaccagcagtcaacccgggccaagaagcctgcttacacttcacggcaccggggagcccagacagtaagtgcctaaagattaaagtgaagcgaatcaacctcaaatgcaagaaatctagtagctactttgtacccgacgccagaagtcgctgcactagcgtacgcagatgtagatgggcgggagattgccaatccggatgcccaccccacttcacaagcaactcattcagcgacgactgggccggcaaaatggaccgggcaggactcggattctccggctgctccgacggatgcggcggagctgcttgtggctgcttcaacgcagcaccaagctgcatcttttggcggaaatgggtcgaaaacccccacggaatcatctggaaagtatccccatgcgcagcctgggtgccatcagctgtgatcgagctcaccatgcccagcggcgaagtacgaaccttccacccgatgtccggcatccccacccaagtcttcaaaggtgtctccgtcacctatctaggctctgacatggaagtgagcggattgaccgacctttgcgaaatcgaggagctaaaatcaaagaaactagccctagcaccctgcaaccaggccgggatgggagtagttggaaaagtcggagagatccagtgctcctcagaagaaagcgcccgaacgatcaagaaagacggttgcatatggaacgccgacctagtcggaatcgaacttcgtgtcgacgacgcagtctgctacagcaaaatcacctcagtcgaggctgtagccaactacagtgccatccctacgaccatcgggggcctgcgattcgaacgcagccacgatagccaaggaaaaatctcaggcagcccactcgacataacagcgatcagaggcagcttctccgtcaactaccgaggactccgcctaagcctctcagaaataacggccacttgcacaggtgaggttaccaacgtaagcgggtgttacagctgcatgacaggagcaaaagtaagcattaagttgcactcgagcaaaaactcaaccgctcacgtaagatgcaaaggcgacgagaccgcattcagcgtcctggagggagtacacagttacattgtctcgctcagcttcgaccatgctgtcgtcgatgaacaatgccaactaaactgcggcggacacgaaagccaagtaaccctcaaaggaaacttaatttttctggacgtccccaaattcgtcgacggctcatacatgcaaacctaccactcaacagtcccgactggagcaaacatccccagccccacagactggctcaacgcgctctttggcaacgggttaagcagatggatcctcggagtaataggagttctcctaggcgggctcgcactcttcttcttaatcgtattccttctaaaacttggaactaaacaggcgttcaggtcaagaacaaaactcgcgtaa

SEQ ID NO: 16579 - protein, 428 aa, synthetic construct; identical to SEQ ID NO: 234
  REGION 1..428: note = derived and/or modified protein sequence (wt) from ANDV(Chile-9717869)__AF291702.1__N

SEQ ID NO: 16580 - protein, 1138 aa, synthetic construct; identical to SEQ ID NO: 926
  REGION 1..1138: note = derived and/or modified protein sequence (wt) from ANDV(Chile-9717869)__AF291703.2__GP

SEQ ID NO: 16581 - protein, 1138 aa, synthetic construct
  REGION 1..1138: note = derived and/or modified protein sequence (wt) from ANDV(Chile-9717869)__AF291703.2__IgE-leader_Gn-Gc
MDWTWILFLVAAATRVHSMPKTIYELKMECPHTVGLGQGYIIGSTELGLISIEAASDIKLESSCNFDLHTTSMAQKSFTQVEWRKKSDTTDTTNAASTTFEAQTKTVNLRGTCILAPELYDTLKKVKKTVLCYDLTCNQTHCQPTVYLIAPVLTCMSIRSCMASVFTSRIQVIYEKTHCVTGQLIEGQCFNPAHTLTLSQPAHTYDTVTLPISCFFTPKKSEQLKVIKTFEGILTKTGCTENALQGYYVCFLGSHSEPLIVPSLEDIRSAEVVSRMLVHPRGEDHDAIQNSQSHLRIVGPITAKVPSTSSTDTLKGTAFAGVPMYSSLSTLVRNADPEFVFSPGIVPESNHSTCDKKTVPITWTGYLPISGEMEKVTGCTVFCTLAGPGASCEAYSENGIFNISSPTCLVNKVQRFRGSEQKINFICQRVDQDVVVYCNGQKKVILTKTLVIGQCIYTFTSLFSLMPDVAHSLAVELCVPGLHGWATVMLLSTFCFGWVLIPAVTLIILKCLRVLTFSCSHYTNESKFKFILEKVKIEYQKTMGSMVCDVCHHECETAKELESHRQSCINGQCPYCMTITEATESALQAHYSICKLTGRFQEALKKSLKKPEVKKGCYRTLGVFRYKSRCYVGLVWCLLLTCEIVIWAASAETPLMESGWSDTAHGVGEIPMKTDLELDFSLPSSSSYSYRRKLTNPANKEESIPFHFQMEKQVIHAEIQPLGHWMDATFNIKTAFHCYGACQKYSYPWQTSKCFFEKDYQYETGWGCNPGDCPGVGTGCTACGVYLDKLKSVGKAYKIISLKYTRKVCIQLGTEQTCKHIDANDCLVTPSVKVCIVGTVSKLQPSDTLLFLGPLEQGGIILKQWCTTSCAFGDPGDIMSTPSGMRCPEHTGSFRKICGFATTPVCEYQGNTISGYKRMMATKDSFQSFNLTEPHITTNKLEWIDPDGNTRDHVNLVLNRDVSFQDLSDNPCKVDLHTQAIEGAWGSGVGFTLTCTVGLTECPSFMTSIKACDLAMCYGSTVTNLARGSNTVKVVGKGGHSGSSFKCCHDTDCSSEGLLASAPHLERVTGFNQIDSDKVYDDGAPPCTFKCWFTKSGEWLLGILNGNWIVVVVLVVILILSIIMFSVLCPRRGHKKTV

SEQ ID NO: 16582 - RNA, 1287 nt, synthetic construct; identical to SEQ ID NO: 2569
  misc_feature 1..1287: note = derived and/or modified CDS sequence (wt) from ANDV(Chile-9717869)__AF291702.1__N
  source 1..1287: mol_type = other RNA

SEQ ID NO: 16583 - RNA, 1287 nt, synthetic construct
  misc_feature 1..1287: note = derived and/or modified CDS sequence (wt) from ANDV(Chile-9717869)__AF291702.1__N
  source 1..1287: mol_type = other RNA
atgagcaccctccaagaattgcaggaaaacatcacagcacacgaacaacagctcgtgactgctcggcaaaagctgaaggatgccgagaaggcagtggaggtggacccggatgacgttaacaagagcacactacaaagtagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacacctttacgtctcaatgccaactgcacagtccactatgaaggctgaagaaatcacgccaggacgatttaggacaattgcttgtggcctttttccagcacaggtcaaagcccgaaatataataagtcctgtaatgggagtaattggatttggcttctttgtaaaggattggatggatcggatagaagagtttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccattcagtctgggtgtttgcatgtgcacctgaccggtgccctccaactgcattgtatgttgcaggggtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtag

SEQ ID NO: 16584 - RNA, 3417 nt, synthetic construct; identical to SEQ ID NO: 3261
  misc_feature 1..3417: note = derived and/or modified CDS sequence (wt) from ANDV(Chile-9717869)__AF291703.2__GP
  source 1..3417: mol_type = other RNA

SEQ ID NO: 16585 - RNA, 3417 nt, synthetic construct
  misc_feature 1..3417: note = derived and/or modified CDS sequence (wt) from ANDV(Chile-9717869)__AF291703.2__GP
  source 1..3417: mol_type = other RNA
atggaagggtggtatctggttgttcttggagtctgctatacgctgacactggcaatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaatcctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaactcacaaagtcacttaagaatagtgggacctatcacagcaaaagtgccatcaacaagttccacagataccctaaaggggacagcctttgcaggcgtcccaatgtatagctctttatctacacttgtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagctggaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaa

SEQ ID NO: 16586 - RNA, 3417 nt, synthetic construct
  misc_feature 1..3417: note = derived and/or modified CDS sequence (wt) from ANDV(Chile-9717869)__AF291703.2__IgE-leader_Gn-Gc
  source 1..3417: mol_type = other RNA
atggactggacctggatcctgttcctcgtggccgccgcgacccgcgtccacagcatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaattctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttaagaatagtgggacctatcacagcaaaagtgccatcaactagttccacagataccctaaaggggacagcctttgcaggcgtcccaatgtatagctctttatctacactagtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagcttgaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaa

SEQ ID NO: 16587 - RNA, 3417 nt, synthetic construct
  misc_feature 1..3417: note = derived and/or modified CDS sequence (wt) from ANDV(Chile-9717869)__AF291703.2__IgE-leader_Gn-Gc
  source 1..3417: mol_type = other RNA
atggactggacctggatcctgttcctcgtggccgccgcgacccgcgtccacagcatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaatcctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaactcacaaagtcacttaagaatagtgggacctatcacagcaaaagtgccatcaacaagttccacagataccctaaaggggacagcctttgcaggcgtcccaatgtatagctctttatctacacttgtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagctggaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaa

SEQ ID NO: 16588 - RNA, 1287 nt, synthetic construct; identical to SEQ ID NO: 4904
  misc_feature 1..1287: note = derived and/or modified CDS sequence (opt4) from ANDV(Chile-9717869)__AF291702.1__N
  source 1..1287: mol_type = other RNA

SEQ ID NO: 16589 - RNA, 3417 nt, synthetic construct; identical to SEQ ID NO: 8364
  misc_feature 1..3417: note = derived and/or modified CDS sequence (opt4) from ANDV(Chile-9717869)__AF291703.2__GP
  source 1..3417: mol_type = other RNA

SEQ ID NO: 16590 - RNA, 3417 nt, synthetic construct
  misc_feature 1..3417: note = derived and/or modified CDS sequence (opt4) from ANDV(Chile-9717869)__AF291703.2__IgE-leader_Gn-Gc
  source 1..3417: mol_type = other RNA
atggactggacctggatcctgttcctggtggccgccgccaccagagtgcacagcatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgagaaacgccgaccccgagttcgtgttcagccccggcatcgtgcccgagagcaaccacagcacctgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaagatcgagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtga

SEQ ID NO: 16591 - RNA, 1287 nt, synthetic construct; identical to SEQ ID NO: 5596
  misc_feature 1..1287: note = derived and/or modified CDS sequence (opt3) from ANDV(Chile-9717869)__AF291702.1__N
  source 1..1287: mol_type = other RNA

SEQ ID NO: 16592 - RNA, 3417 nt, synthetic construct; identical to SEQ ID NO: 10007
  misc_feature 1..3417: note = derived and/or modified CDS sequence (opt3) from ANDV(Chile-9717869)__AF291703.2__GP
  source 1..3417: mol_type = other RNA

SEQ ID NO: 16593 - RNA, 3417 nt, synthetic construct
  misc_feature 1..3417: note = derived and/or modified CDS sequence (opt3) from ANDV(Chile-9717869)__AF291703.2__IgE-leader_Gn-Gc
  source 1..3417: mol_type = other RNA
atggactggacctggatcctgttcctcgtggccgctgcaacaagagtccacagcatgcccaagactatctacgaattgaaaatggagtgtcctcacacggtgggattaggtcagggctatattatagggagcaccgaactgggactaatctccattgaggctgcatctgacatcaagctcgaatcaagttgcaacttcgatctgcatacaactagcatggcccaaaaatcctttacccaggtagagtggagaaagaaatctgacacaaccgatactacaaatgcggcttcgaccacgttcgaggcccagactaagaccgtgaaccttaggggcacatgtattctggcaccagaattgtacgacactctcaagaaagtcaagaaaaccgtgctgtgctatgatctgacatgtaatcagacccactgccaaccgacggtttacctcatcgcccccgtgttaacttgtatgtcaatacggagctgcatggctagtgtctttacatcccgcatccaggtgatttatgagaagacccattgtgtaactggtcagctgatcgaagggcagtgcttcaaccctgcacacacacttaccttgtctcaaccagcccatacgtacgacaccgttacactgcccattagctgtttcttcactcctaaaaagtccgagcagctaaaggtgatcaaaacctttgagggaatactcacaaagactggctgcaccgaaaatgctctgcagggctactatgtctgcttccttgggtcacacagtgagccactgattgtgcccagcttggaagatatccgatctgccgaggtggtctcccgtatgctcgttcaccctagaggagaagaccatgatgcgattcagaactcacaaagccacctgaggatcgtgggtccaatcacagcaaaagtaccgagtacctcttccactgacacgttaaagggcacagcctttgctggggtgcccatgtacagctcgctgtctaccctcgtccggaatgccgatcctgagttcgtgttttccccaggaattgttcccgagtcaaaccatagtacttgtgacaaaaagaccgtgcctataacatggaccggctatcttccaatcagcggtgaaatggagaaagtcactgggtgcacagtgttctgtacgctggcaggacccggcgcttcctgcgaagcctactctgagaatggcatttttaacatcagctcaccgacctgtttggtaaataaggttcagcgcttcagagggagtgaacagaagataaacttcatttgccaaagggtggatcaggacgtcgtggtctattgtaatggacagaaaaaggtgatcctaactaaaacactggttatcggtcagtgcatttacacctttacatccctcttcagcctgatgcctgacgtggcgcactctcttgccgtagagctgtgtgtccccggcttgcacgggtgggcaactgtgatgctcctgtcaaccttttgcttcggatgggttttaatcccagctgtgacgctgattatactaaagtgtctccgggtcctgacctttagttgcagccattatacaaacgagtccaaattcaagtttatccttgaaaaggtgaaaattgagtaccaaaagactatgggctctatggtatgcgatgtgtgtcaccatgaatgcgagaccgccaaagaattggagtcgcaccgccagagctgtatcaatggtcagtgcccttactgtatgacaatcactgaggctaccgaatccgccctgcaggcacattattcaatttgcaagctcacggggcgattccaagaggccctgaaaaagagtcttaagaaacccgaagttaagaaaggctgttacagaacactgggagtctttaggtataagtctcggtgctacgtgggcttggtgtggtgtctcctgttaacctgcgagatagtcatctgggctgcgagcgcagagactccactgatggaatccgggtggtcagacacagcccacggagttggtgagattcccatgaaaaccgatctagaactcgacttcagcctgccttcttccagtagctattcttaccgtcgcaagctcactaacccagctaacaaggaggaatccatcccgtttcacttccagatggagaaacaggtgattcatgccgagatccagcccttgggccactggatggatgcaacctttaatataaagacagccttccattgttatggggcttgccaaaaatactcatacccttggcagacgagtaagtgcttctttgaaaaagactatcagtacgagaccggatggggctgtaacccaggtgattgccccggggtgggcactggatgtacagcctgcggcgtatatctggacaagctcaaaagcgtcgggaaggcatacaagatcatttcgctgaaatataccagaaaggtgtgtatccagttaggaacagaacaaacttgcaaacacattgatgcgaatgactgtctggttaccccttccgtgaaggtctgcatcgtgggtacggtttctaaacttcagccaagcgatacattgctctttctgggccccctagagcaagggggaataattctgaagcagtggtgtaccacttcatgcgcttttggcgacccgggtgacatcatgagtaccccttccgggatgaggtgtccagaacacacaggctctttccggaagatttgcggatttgccactacccccgtgtgcgagtaccagggcaacacaatcagcgggtataaacgaatgatggcaacgaaggattccttccagtcatttaatctcaccgagcctcatataactacaaacaaactggaatggatcgaccccgatggaaatacccgcgaccacgtaaaccttgtcttgaatagagatgtgagcttccaggacctgagtgataacccatgtaaggtggacttacatactcaagccattgagggcgcttggggttctggggtcggatttacacttacctgcacggttggcctgactgaatgtccttccttcatgaccagcatcaaagcctgcgatcttgcaatgtgttacggttcgacagtgaccaatctggctaggggctcaaacactgtaaaggtggtcgggaagggaggccactctgggagttcctttaaatgctgtcatgacacagattgcagctctgagggattgctcgccagcgcgccccacctggaacgggtgaccggcttcaatcagattgactccgataaggtttacgacgacggtgccccaccgtgtacatttaaatgctggttcactaagtcaggggagtggctactgggaatcctcaacggcaattggatagtggtcgtggttctggtggtcattcttatcttgagtatcattatgttcagcgtactgtgtcctcgcagaggtcacaaaaagaccgtgtga

SEQ ID NO: 16594 - RNA, 1287 nt, synthetic construct; identical to SEQ ID NO: 6288
  misc_feature 1..1287: note = derived and/or modified CDS sequence (opt1) from ANDV(Chile-9717869)__AF291702.1__N
  source 1..1287: mol_type = other RNA

SEQ ID NO: 16595 - RNA, 3417 nt, synthetic construct; identical to SEQ ID NO: 11650
  misc_feature 1..3417: note = derived and/or modified CDS sequence (opt1) from ANDV(Chile-9717869)__AF291703.2__GP
  source 1..3417: mol_type = other RNA

SEQ ID NO: 16596 - RNA, 3417 nt, synthetic construct
  misc_feature 1..3417: note = derived and/or modified CDS sequence (opt1) from ANDV(Chile-9717869)__AF291703.2__IgE-leader_Gn-Gc
  source 1..3417: mol_type = other RNA
atggactggacctggatcctgttcctcgtggccgccgcgacccgcgtccacagcatgcccaagacgatctacgagctcaagatggagtgcccgcacaccgtgggcctggggcagggctacatcatcgggagcaccgagctgggcctcatctccatcgaggccgccagcgacatcaagctggagtccagctgcaacttcgacctgcacaccacgtccatggcccagaagtccttcacccaggtcgagtggcgcaagaagtccgacaccaccgacacgaccaacgccgccagcaccaccttcgaggcccagacgaagaccgtgaacctccgggggacctgcatcctggcgcccgagctgtacgacaccctcaagaaggtgaagaagacggtcctgtgctacgacctgacctgcaaccagacccactgccagcccaccgtgtacctcatcgcccccgtgctgacgtgcatgagcatccgcagctgcatggcctccgtcttcaccagccggatccaggtgatctacgagaagacccactgcgtgaccgggcagctgatcgagggccagtgcttcaacccggcccacacgctcaccctgtcccagcccgcgcacacctacgacaccgtcacgctgcccatcagctgcttcttcacccccaagaagtccgagcagctcaaggtgatcaagaccttcgaggggatcctgaccaagacgggctgcaccgagaacgccctgcaggggtactacgtgtgcttcctcggcagccactccgagccgctgatcgtccccagcctggaggacatccgctccgccgaggtggtgagccggatgctcgtccacccccgcggcgaggaccacgacgccatccagaacagccagtcccacctccggatcgtggggcccatcaccgccaaggtgccgagcacctccagcacggacaccctgaagggcaccgcgttcgccggggtccccatgtactccagcctgtccaccctggtgcgcaacgccgaccccgagttcgtgttcagccccggcatcgtcccggagtccaaccacagcacgtgcgacaagaagaccgtgcccatcacctggaccggctacctgcccatctccggggagatggagaaggtcaccggctgcacggtgttctgcaccctcgccgggcccggcgccagctgcgaggcgtactccgagaacgggatcttcaacatcagctccccgacctgcctggtgaacaaggtccagcggttccgcggcagcgagcagaagatcaacttcatctgccagcgggtggaccaggacgtggtcgtgtactgcaacggccagaagaaggtgatcctgaccaagacgctcgtcatcgggcagtgcatctacaccttcacctccctgttcagcctgatgcccgacgtggcccactccctcgccgtggagctgtgcgtccccggcctgcacgggtgggccaccgtgatgctcctgagcacgttctgcttcggctgggtgctgatccccgccgtcaccctcatcatcctgaagtgcctgcgcgtgctcaccttcagctgctcccactacaccaacgagagcaagttcaagttcatcctggagaaggtgaagatcgagtaccagaagacgatggggtccatggtctgcgacgtgtgccaccacgagtgcgagaccgcgaaggagctggagagccaccggcagtcctgcatcaacggccagtgcccgtactgcatgaccatcaccgaggccacggagagcgccctgcaggcccactactccatctgcaagctcaccggccgcttccaggaggccctgaagaagtccctgaagaagcccgaggtgaagaaggggtgctaccggaccctcggcgtcttccgctacaagagccggtgctacgtggggctggtgtggtgcctgctcctgacctgcgagatcgtcatctgggcggccagcgccgagacgcccctgatggagtccggctggagcgacaccgcccacggggtgggcgagatccccatgaagaccgacctcgagctggacttctccctgccgagctccagctcctacagctaccgccggaagctcaccaaccccgcgaacaaggaggagagcatccccttccacttccagatggagaagcaggtcatccacgccgagatccagccgctgggccactggatggacgccacgttcaacatcaagaccgccttccactgctacggggcctgccagaagtactcctacccctggcagaccagcaagtgcttcttcgagaaggactaccagtacgagaccggctgggggtgcaaccccggcgactgccccggcgtggggacgggctgcaccgcgtgcggggtgtacctggacaagctcaagtccgtgggcaaggcctacaagatcatcagcctgaagtacacccgcaaggtctgcatccagctggggaccgagcagacgtgcaagcacatcgacgccaacgactgcctcgtgaccccgtccgtgaaggtctgcatcgtgggcaccgtgagcaagctgcagccctccgacaccctcctgttcctgggccccctggagcagggcggcatcatcctcaagcagtggtgcaccacgagctgcgccttcggggaccccggcgacatcatgtccaccccgagcgggatgcggtgccccgagcacaccggctccttccgcaagatctgcggcttcgccaccacgcccgtctgcgagtaccaggggaacaccatcagcggctacaagcgcatgatggcgaccaaggactccttccagagcttcaacctgaccgagccccacatcacgaccaacaagctggagtggatcgacccggacgggaacacccgggaccacgtgaacctcgtgctgaaccgcgacgtctccttccaggacctgagcgacaacccctgcaaggtggacctccacacccaggccatcgagggcgcctgggggtccggcgtgggcttcacgctgacctgcaccgtcgggctgaccgagtgccccagcttcatgacgtccatcaaggcctgcgacctcgccatgtgctacggcagcaccgtgaccaacctggcgcgggggagcaacaccgtgaaggtcgtgggcaagggcgggcactccggcagctccttcaagtgctgccacgacacggactgcagctccgaggggctgctcgccagcgcgccccacctggagcgcgtgaccggcttcaaccagatcgactccgacaaggtctacgacgacggggccccgccctgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagacggtctga

SEQ ID NO: 16597 - RNA, 1287 nt, synthetic construct; identical to SEQ ID NO: 6980
  misc_feature 1..1287: note = derived and/or modified CDS sequence (opt5) from ANDV(Chile-9717869)__AF291702.1__N
  source 1..1287: mol_type = other RNA

SEQ ID NO: 16598 - RNA, 3417 nt, synthetic construct; identical to SEQ ID NO: 13293
  misc_feature 1..3417: note = derived and/or modified CDS sequence (opt5) from ANDV(Chile-9717869)__AF291703.2__GP
  source 1..3417: mol_type = other RNA

SEQ ID NO: 16599 - RNA, 3417 nt, synthetic construct
  misc_feature 1..3417: note = derived and/or modified CDS sequence (opt5) from ANDV(Chile-9717869)__AF291703.2__IgE-leader_Gn-Gc
  source 1..3417: mol_type = other RNA
atggactggacctggatcctgttcctcgtggccgctgccacaagagtccacagcatgcccaagacgatctacgaactgaaaatggagtgtcctcacaccgtgggactcggccaggggtatattatcggaagcacagaactgggccttatttccatcgaggctgcctctgacattaagctggaaagctcctgcaacttcgatctccataccacatctatggcgcaaaagagctttacccaggtggagtggagaaagaaatccgacacaaccgatacgaccaatgctgcctctacaaccttcgaggcccagacaaagaccgtcaacctgcgggggacgtgtatcctggctccggaactctacgacacactgaagaaagtgaagaaaaccgttctttgctatgatctgacatgtaatcagacccactgccaacccaccgtgtacctcatcgcccctgtcctgacatgtatgagcattcgctcctgcatggctagcgtgtttacgtctagaatccaggttatttatgagaagacccattgtgtgacaggacagcttatcgaaggccagtgcttcaaccccgcccacaccctgacactctcccaacctgcgcatacctacgacacggtcacactgcccattagctgctttttcacccctaaaaagtctgagcagctgaaggtgatcaaaacctttgagggcattctcacaaagaccgggtgcacagaaaatgccctgcagggatactatgtgtgcttccttggctcccacagcgagccgctgatcgtcccctctctcgaagatatccggtccgctgaggttgtgagccgcatgctggtgcaccctagaggggaagaccatgatgccattcagaactcccaatctcaccttcggatcgtcggacccattacggctaaagtgcctagcacctccagcacagacaccctgaagggcacagcctttgcgggggttcccatgtactcttccctcagcaccctggtgcgcaatgccgatccggagttcgtcttttctcctggaatcgtgcccgagagcaaccattccacgtgtgacaaaaagaccgttcctattacatggaccggctatctgcccatctctggcgaaatggagaaagtgacagggtgcaccgtcttctgtacgctcgctggacccggcgccagctgcgaagcctactccgagaatgggatctttaacattagctctcctacatgtctggtgaataaggtccagagattccggggatccgaacagaagatcaacttcatttgccaacgcgtggatcaggacgttgtggtctattgtaatggccagaaaaaggtgatccttaccaaaacactggttattgggcagtgcatctacacctttaccagcctcttctctctgatgccggacgtggcccactcccttgccgtcgagctgtgtgtgcccggactccacggctgggctacagtgatgctgctgagcacgttttgcttcggctgggttctcatccctgcggtcaccctgattatccttaagtgtctgagagtgctcacattttcctgctctcattataccaacgagagcaaattcaagtttattctggaaaaggtgaaaatcgagtaccaaaagacaatggggtccatggtctgcgatgtgtgtcaccatgaatgcgagaccgccaaagaactggagtctcaccggcagagctgtattaatggacagtgcccctactgtatgacgatcacagaggctaccgaatccgcccttcaggcccattatagcatttgcaagctcaccggccgcttccaagaggctctgaaaaagtctctgaagaaacctgaagttaagaaagggtgttacagaacactcggagtgtttcggtataagtcccgctgctacgtcggcctggtgtggtgtcttctgctcacctgtgagatcgttatctgggccgcgagcgctgagacacccctgatggaatctgggtggtccgacacggcccacggcgtgggagagattccgatgaaaaccgatctggaacttgacttcagcctcccttctagctccagctattcttacagacggaagctgacaaaccccgccaacaaggaggaatccatcccttttcacttccagatggagaaacaggtcattcatgctgagatccagcccctgggccactggatggatgccacctttaatattaagacagctttccattgttatggggcctgccaaaaatacagctacccttggcagacctccaagtgcttctttgaaaaagactatcagtacgagacgggatggggctgtaaccccggggattgcccgggagtgggcaccgggtgtacagcgtgcggcgtttatctcgacaagctgaaatctgtgggaaaggcctacaagatcatcagccttaaatataccagaaaggtctgtattcagctgggcacagaacaaacctgcaaacacatcgatgctaatgactgtctcgtgacaccttccgtgaaggtctgcattgttgggaccgtgtctaaactgcagcccagcgatacgctgcttttcctcggacccctggagcagggcgggatcattctgaagcaatggtgtacaacctcctgcgcctttggagaccctggcgacatcatgtctaccccgagcgggatgcgctgtcccgaacacacaggctccttccggaagatctgcggatttgctaccacgcctgtgtgcgagtaccagggcaacacaattagcgggtataaaagaatgatggccaccaaggattctttccagtcctttaatctcacagagccccatatcaccacaaacaaactggaatggattgaccctgatggaaatacccgcgaccacgtcaaccttgtgctgaatcgggatgttagcttccaggacctctctgataacccctgtaaggtggacctgcatacgcaagcgatcgagggcgcctgggggtccggagtcggctttaccctgacatgcaccgtggggcttacagaatgtcctagcttcatgacctctattaaggcttgcgatctcgccatgtgttacggctccacggttacaaatctggctagaggaagcaacaccgtgaaagtcgtgggcaaagggggacactccggcagctcttttaaatgctgtcatgacacagattgcagctccgaggggctgctcgcctctgctccccacctggaacgcgttaccggattcaatcagatcgacagcgataaggtgtacgacgacggcgctccgccttgtacctttaaatgctggttcacaaagtccggcgagtggcttctggggatcctcaacggaaattggattgtcgtggtggtcctggttgtgatcctgattctttctatcattatgttcagcgtgctgtgtccccggagaggccacaaaaagacggtctga

SEQ ID NO: 16600 - RNA, 1287 nt, synthetic construct; identical to SEQ ID NO: 7672
  misc_feature 1..1287: note = derived and/or modified CDS sequence (opt11) from ANDV(Chile-9717869)__AF291702.1__N
  source 1..1287: mol_type = other RNA

SEQ ID NO: 16601 - RNA, 3417 nt, synthetic construct; identical to SEQ ID NO: 14936
  misc_feature 1..3417: note = derived and/or modified CDS sequence (opt11) from ANDV(Chile-9717869)__AF291703.2__GP
  source 1..3417: mol_type = other RNA

SEQ ID NO: 16602 - RNA, 3417 nt, synthetic construct
  misc_feature 1..3417: note = derived and/or modified CDS sequence (opt11) from ANDV(Chile-9717869)__AF291703.2__IgE-leader_Gn-Gc
  source 1..3417: mol_type = other RNA
atggattggacgtggatactctttctcgtggccgcggccacgcgcgtgcactcgatgccaaaaacaatttacgaactcaagatggaatgtccccacaccgtcggcctaggccaaggctacattatcggttctactgaactgggactaatttccatagaagcggcatctgacatcaaactcgagagcagctgcaacttcgaccttcacacaacttccatggcccagaaatctttcacgcaggtcgaatggcgcaagaaatcagacacaacggacaccacaaacgcggcctcaaccacctttgaagcccaaaccaaaaccgtaaacctacgaggaacctgtatcctcgcacccgagctttacgacaccctcaagaaagtcaaaaagaccgtactctgctacgacctaacctgcaatcagacacactgccaaccaaccgtatatctaatcgctcccgtattaacatgcatgtccatccgaagctgcatggcatcagtcttcaccagcagaatacaagtaatctatgaaaagacccactgtgtcacaggccaattaatcgaaggccagtgcttcaatccagcccacaccctcaccctatcacaacccgcccacacctacgatacagtcacacttcccatatcctgcttcttcacacccaagaaatccgagcaactcaaagtgatcaaaacctttgagggcattctgaccaaaaccggctgtaccgagaacgcgctccaaggctattacgtgtgttttctaggcagtcactccgaaccactgatcgtaccatccctcgaagacatccggtcggccgaagtagtctcccgcatgctcgttcacccacgaggcgaagaccacgacgctatccaaaactcacaatcccatctgcgcatcgtcggaccaataaccgcgaaggtcccgtcaacgtcgtccaccgacacactcaaaggcaccgcctttgccggcgtacccatgtactcctccctatccacgctcgtccgaaatgccgaccccgagttcgtattctcaccaggcatagtaccggaaagcaaccactccacgtgcgacaagaaaacggtccccatcacttggaccggctacctgccaatctcaggggaaatggaaaaagtcaccggttgcactgttttctgcactctagcaggcccaggcgcaagctgcgaagcctactcagaaaacggcatattcaacattagcagcccaacatgtctcgtaaacaaagtacaacgctttcgaggctccgaacagaaaataaacttcatatgccaaagggtcgaccaagacgtcgtagtctactgcaacggccaaaagaaagtaatcctcaccaaaacactcgtcatcggacagtgcatctacacatttacctcactattcagcctcatgccagatgtcgcgcactcccttgcagtggagctctgcgtaccagggctacacggctgggccaccgtaatgcttctatccacattttgcttcgggtgggtcctaattcccgccgtcaccctgatcatactaaaatgcctccgagtcctcactttctcgtgctcacactacacaaacgaatccaaattcaaattcatactcgaaaaagtaaaaatagaataccagaaaacgatgggatcaatggtatgcgacgtatgtcaccacgagtgtgagaccgccaaagaacttgaatcgcaccgccaatcctgcatcaacggacaatgcccatactgcatgaccataacagaagcaaccgaaagcgccctccaagcccactactcaatctgcaaactgaccggaaggttccaggaagcccttaagaaatccctaaagaaacccgaggtaaagaaaggctgctaccgcacgctcggagtcttccgatacaaatctcgctgttacgtaggcctagtctggtgcctactcctaacctgcgaaatagtcatctgggcggcctcggccgaaaccccgctcatggaatccggctggtccgacaccgcccacggagtcggagaaataccaatgaaaacagacctcgaactcgacttctctctaccctcctcctcaagctacagctaccgccgcaaacttaccaaccccgccaataaagaagaaagtatcccatttcacttccaaatggagaaacaagtaattcacgccgaaatccagcctctcggccactggatggacgcaaccttcaacatcaaaacagcgttccactgctacggcgcctgccaaaaatacagctacccctggcagacctccaaatgtttcttcgagaaagactaccaatacgaaacagggtggggctgtaaccccggcgactgcccaggagtcggtacaggctgtactgcctgtggcgtctacctcgacaaactaaaatctgtaggcaaagcatacaaaatcatcagcctgaaatacacacgcaaagtatgtatccaactaggaacagaacaaacgtgcaaacacattgatgccaacgactgccttgtgacaccctccgtcaaagtatgcatcgttggaaccgtatccaaactccaaccctccgacaccctcctatttcttggtcccctagaacaagggggcatcatccttaaacaatggtgcaccacctcctgcgcattcggagacccaggcgacataatgtcaaccccaagcggaatgcgatgtccagagcacacaggctcctttcgcaaaatatgcggcttcgcaaccacaccggtctgcgaataccaaggcaacacaatctccggctacaaaagaatgatggccacgaaagactccttccaatcgttcaacctcaccgaaccccatatcacaaccaacaaactcgagtggattgaccccgacggcaacacccgcgaccacgtcaacctcgtcctcaaccgtgacgtatcgttccaagacctcagcgacaacccctgcaaagtcgacctacacacacaggcgatcgaaggcgcttggggtagcggcgtcggcttcacactaacctgcaccgttggactcaccgaatgcccttccttcatgacttccatcaaggcatgcgacctcgccatgtgctacggctccaccgtcacaaacctggccagaggatccaacaccgtaaaagttgtaggaaaaggcggccactcaggaagcagctttaaatgctgccacgacaccgattgctcctctgaaggcctacttgcctccgcgccacacctagaacgcgtaaccgggttcaaccagatagacagcgacaaggtgtacgacgacggcgcgcctccatgcactttcaaatgctggttcacaaaatcaggagaatggctcttaggcatactcaacggcaattggatagtagtcgtcgtcctagtagtaatactgatcttatctatcatcatgttctcagttctttgccccagacgggggcacaagaagacagtctaa

SEQ ID NO: 16603 - RNA, 1504 nt, synthetic construct
  misc_feature 1..1504: note = mRNA product Design1 comprising derived and/or modified sequence from ANDV(Chile-9717869)__AF291702.1__N (wt)
  source 1..1504: mol_type = other RNA
gggagaaagcttaccatgagcaccctccaagaattgcaggaaaacatcacagcacacgaacaacagctcgtgactgctcggcaaaagcttaaggatgccgagaaggcagtggaggtggacccggatgacgttaacaagagcacactacaaagtagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacacctttacgtctcaatgccaactgcacagtccactatgaaggctgaagaaatcacgccaggacgatttaggacaattgcttgtggcctttttccagcacaggtcaaagcccgaaatataataagtcctgtaatgggagtaattggatttggcttctttgtaaaggattggatggatcggatagaagagtttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccattcagtctgggtgtttgcatgtgcacctgaccggtgccctccaactgcattgtatgttgcaggggtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16604 - RNA, 1504 nt, synthetic construct
  misc_feature 1..1504: note = mRNA product Design1 comprising derived and/or modified sequence from ANDV(Chile-9717869)__AF291702.1__N (wt)
  source 1..1504: mol_type = other RNA
gggagaaagcttaccatgagcaccctccaagaattgcaggaaaacatcacagcacacgaacaacagctcgtgactgctcggcaaaagctgaaggatgccgagaaggcagtggaggtggacccggatgacgttaacaagagcacactacaaagtagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacacctttacgtctcaatgccaactgcacagtccactatgaaggctgaagaaatcacgccaggacgatttaggacaattgcttgtggcctttttccagcacaggtcaaagcccgaaatataataagtcctgtaatgggagtaattggatttggcttctttgtaaaggattggatggatcggatagaagagtttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccattcagtctgggtgtttgcatgtgcacctgaccggtgccctccaactgcattgtatgttgcaggggtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16605 - RNA, 3634 nt, synthetic construct
  misc_feature 1..3634: note = mRNA product Design1 comprising derived and/or modified sequence from ANDV(Chile-9717869)__AF291703.2__GP (wt)
  source 1..3634: mol_type = other RNA
gggagaaagcttaccatggaagggtggtatctggttgttcttggagtctgctatacgctgacactggcaatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaattctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttaagaatagtgggacctatcacagcaaaagtgccatcaactagttccacagataccctaaaggggacagcctttgcaggcgtcccaatgtatagctctttatctacactagtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagcttgaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16606 - RNA, 3634 nt, synthetic construct
  misc_feature 1..3634: note = mRNA product Design1 comprising derived and/or modified sequence from ANDV(Chile-9717869)__AF291703.2__GP (wt)
  source 1..3634: mol_type = other RNA
gggagaaagcttaccatggaagggtggtatctggttgttcttggagtctgctatacgctgacactggcaatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaatcctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaactcacaaagtcacttaagaatagtgggacctatcacagcaaaagtgccatcaacaagttccacagataccctaaaggggacagcctttgcaggcgtcccaatgtatagctctttatctacacttgtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagctggaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16607 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (wt)
  source 1..3634: mol_type = other RNA
gggagaaagcttaccatggactggacctggatcctgttcctcgtggccgccgcgacccgcgtccacagcatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaattctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttaagaatagtgggacctatcacagcaaaagtgccatcaactagttccacagataccctaaaggggacagcctttgcaggcgtcccaatgtatagctctttatctacactagtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagcttgaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16608 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (wt)
  source 1..3634: mol_type = other RNA
gggagaaagcttaccatggactggacctggatcctgttcctcgtggccgccgcgacccgcgtccacagcatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaatcctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaactcacaaagtcacttaagaatagtgggacctatcacagcaaaagtgccatcaacaagttccacagataccctaaaggggacagcctttgcaggcgtcccaatgtatagctctttatctacacttgtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagctggaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16609 - RNA, 1504 nt, synthetic construct
  misc_feature 1..1504: note = mRNA product Design1 comprising derived and/or modified sequence from ANDV(Chile-9717869)__AF291702.1__N (opt4)
  source 1..1504: mol_type = other RNA
gggagaaagcttaccatgagcaccctgcaggagctgcaggagaacatcaccgcccacgagcagcagctggtgaccgccagacagaagctgaaggacgccgagaaggccgtggaggtggaccccgacgacgtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcggcttcttcgtgaaggactggatggacagaatcgaggagttcctggccgccgagtgccccttcctgcccaagcccaaggtggccagcgaggccttcatgagcaccaacaagatgtacttcctgaacagacagagacaggtgaacgagagcaaggtgcaggacatcatcgacctgatcgaccacgccgagaccgagagcgccaccctgttcaccgagatcgccaccccccacagcgtgtgggtgttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16610 - RNA, 3634 nt, synthetic construct
  misc_feature 1..3634: note = mRNA product Design1 comprising derived and/or modified sequence from ANDV(Chile-9717869)__AF291703.2__GP (opt4)
  source 1..3634: mol_type = other RNA
gggagaaagcttaccatggagggctggtacctggtggtgctgggcgtgtgctacaccctgaccctggccatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgagaaacgccgaccccgagttcgtgttcagccccggcatcgtgcccgagagcaaccacagcacctgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaagatcgagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16611 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (opt4)
  source 1..3634: mol_type = other RNA
gggagaaagcttaccatggactggacctggatcctgttcctggtggccgccgccaccagagtgcacagcatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgagaaacgccgaccccgagttcgtgttcagccccggcatcgtgcccgagagcaaccacagcacctgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaagatcgagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16612 - RNA, 1504 nt, synthetic construct
  misc_feature 1..1504: note = mRNA product Design1 comprising derived and/or modified sequence from ANDV(Chile-9717869)__AF291702.1__N (opt3)
  source 1..1504: mol_type = other RNA
gggagaaagcttaccatgagcaccctgcaggagctccaagaaaacatcacagcccacgagcagcagcttgtgactgctagacagaagctgaaagacgcagaaaaggccgtcgaggttgatcccgacgatgtgaataaatccacgttgcaatctaggcgggcggctgtatcaaccttagaaacaaagctgggcgagctaaaacgccagctcgccgacctggtggcagcccagaaacttgctactaagcctgtcgatccaaccgggctggagccggacgatcatttgaaagaaaagagtagcctccgatacggaaacgtgctggacgttaattccattgatctggaggaaccctctggtcagacagcagactggaaagccataggcgcttatatcctcgggttcgccattcctatcattttaaaggcgctgtacatgctttcgacccgtggaagacaaactgtgaaagataacaagggcacaaggatccggtttaaggacgatagctcattcgaggaggtcaatggtatacgcaaaccaaagcacttgtatgtgagtatgcccaccgcacagtccacgatgaaagccgaagagatcactcctgggagatttaggaccattgcttgcggactgttcccagcccaggtaaaggcacggaacatcatttctcccgttatgggcgtgatcggctttgggttctttgtcaaagactggatggaccgcatagaagagttcctagctgccgaatgtccttttctcccaaagccgaaagtggcgagcgaggccttcatgtccacaaataagatgtactttctgaaccgacagagacaagtgaatgagtcaaaggtccaggatattatcgaccttattgatcatgcagaaactgagagtgctaccctgttcacagaaatcgccacgccccacagcgtttgggtgtttgcttgcgcccctgacaggtgtccacccaccgcattgtatgtagccggagtgcctgagctcggtgctttcttctctatcctgcaggatatgcggaacactattatggcgtccaaatcagtcggcacagcagaagagaagttaaagaagaaaagcgccttttaccaaagttatctgcgtcgcacccagtctatggggatacagctcgaccagaagatcattatcctttacatgctgtcctggggaaaggaggctgtgaatcatttccacttgggcgatgacatggatccagaactaagacaactggcccagagcctcatagacactaaagttaaggagatttcgaaccaggaacccctgaaactttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16613 - RNA, 3634 nt, synthetic construct
  misc_feature 1..3634: note = mRNA product Design1 comprising derived and/or modified sequence from ANDV(Chile-9717869)__AF291703.2__GP (opt3)
  source 1..3634: mol_type = other RNA
gggagaaagcttaccatggagggctggtacctggtggtcctcggggtttgctatacccttacactggccatgcccaagactatctacgaattgaaaatggagtgtcctcacacggtgggattaggtcagggctatattatagggagcaccgaactgggactaatctccattgaggctgcatctgacatcaagctcgaatcaagttgcaacttcgatctgcatacaactagcatggcccaaaaatcctttacccaggtagagtggagaaagaaatctgacacaaccgatactacaaatgcggcttcgaccacgttcgaggcccagactaagaccgtgaaccttaggggcacatgtattctggcaccagaattgtacgacactctcaagaaagtcaagaaaaccgtgctgtgctatgatctgacatgtaatcagacccactgccaaccgacggtttacctcatcgcccccgtgttaacttgtatgtcaatacggagctgcatggctagtgtctttacatcccgcatccaggtgatttatgagaagacccattgtgtaactggtcagctgatcgaagggcagtgcttcaaccctgcacacacacttaccttgtctcaaccagcccatacgtacgacaccgttacactgcccattagctgtttcttcactcctaaaaagtccgagcagctaaaggtgatcaaaacctttgagggaatactcacaaagactggctgcaccgaaaatgctctgcagggctactatgtctgcttccttgggtcacacagtgagccactgattgtgcccagcttggaagatatccgatctgccgaggtggtctcccgtatgctcgttcaccctagaggagaagaccatgatgcgattcagaactcacaaagccacctgaggatcgtgggtccaatcacagcaaaagtaccgagtacctcttccactgacacgttaaagggcacagcctttgctggggtgcccatgtacagctcgctgtctaccctcgtccggaatgccgatcctgagttcgtgttttccccaggaattgttcccgagtcaaaccatagtacttgtgacaaaaagaccgtgcctataacatggaccggctatcttccaatcagcggtgaaatggagaaagtcactgggtgcacagtgttctgtacgctggcaggacccggcgcttcctgcgaagcctactctgagaatggcatttttaacatcagctcaccgacctgtttggtaaataaggttcagcgcttcagagggagtgaacagaagataaacttcatttgccaaagggtggatcaggacgtcgtggtctattgtaatggacagaaaaaggtgatcctaactaaaacactggttatcggtcagtgcatttacacctttacatccctcttcagcctgatgcctgacgtggcgcactctcttgccgtagagctgtgtgtccccggcttgcacgggtgggcaactgtgatgctcctgtcaaccttttgcttcggatgggttttaatcccagctgtgacgctgattatactaaagtgtctccgggtcctgacctttagttgcagccattatacaaacgagtccaaattcaagtttatccttgaaaaggtgaaaattgagtaccaaaagactatgggctctatggtatgcgatgtgtgtcaccatgaatgcgagaccgccaaagaattggagtcgcaccgccagagctgtatcaatggtcagtgcccttactgtatgacaatcactgaggctaccgaatccgccctgcaggcacattattcaatttgcaagctcacggggcgattccaagaggccctgaaaaagagtcttaagaaacccgaagttaagaaaggctgttacagaacactgggagtctttaggtataagtctcggtgctacgtgggcttggtgtggtgtctcctgttaacctgcgagatagtcatctgggctgcgagcgcagagactccactgatggaatccgggtggtcagacacagcccacggagttggtgagattcccatgaaaaccgatctagaactcgacttcagcctgccttcttccagtagctattcttaccgtcgcaagctcactaacccagctaacaaggaggaatccatcccgtttcacttccagatggagaaacaggtgattcatgccgagatccagcccttgggccactggatggatgcaacctttaatataaagacagccttccattgttatggggcttgccaaaaatactcatacccttggcagacgagtaagtgcttctttgaaaaagactatcagtacgagaccggatggggctgtaacccaggtgattgccccggggtgggcactggatgtacagcctgcggcgtatatctggacaagctcaaaagcgtcgggaaggcatacaagatcatttcgctgaaatataccagaaaggtgtgtatccagttaggaacagaacaaacttgcaaacacattgatgcgaatgactgtctggttaccccttccgtgaaggtctgcatcgtgggtacggtttctaaacttcagccaagcgatacattgctctttctgggccccctagagcaagggggaataattctgaagcagtggtgtaccacttcatgcgcttttggcgacccgggtgacatcatgagtaccccttccgggatgaggtgtccagaacacacaggctctttccggaagatttgcggatttgccactacccccgtgtgcgagtaccagggcaacacaatcagcgggtataaacgaatgatggcaacgaaggattccttccagtcatttaatctcaccgagcctcatataactacaaacaaactggaatggatcgaccccgatggaaatacccgcgaccacgtaaaccttgtcttgaatagagatgtgagcttccaggacctgagtgataacccatgtaaggtggacttacatactcaagccattgagggcgcttggggttctggggtcggatttacacttacctgcacggttggcctgactgaatgtccttccttcatgaccagcatcaaagcctgcgatcttgcaatgtgttacggttcgacagtgaccaatctggctaggggctcaaacactgtaaaggtggtcgggaagggaggccactctgggagttcctttaaatgctgtcatgacacagattgcagctctgagggattgctcgccagcgcgccccacctggaacgggtgaccggcttcaatcagattgactccgataaggtttacgacgacggtgccccaccgtgtacatttaaatgctggttcactaagtcaggggagtggctactgggaatcctcaacggcaattggatagtggtcgtggttctggtggtcattcttatcttgagtatcattatgttcagcgtactgtgtcctcgcagaggtcacaaaaagaccgtgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16614 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (opt3)
  source 1..3634: mol_type = other RNA
gggagaaagcttaccatggactggacctggatcctgttcctcgtggccgctgcaacaagagtccacagcatgcccaagactatctacgaattgaaaatggagtgtcctcacacggtgggattaggtcagggctatattatagggagcaccgaactgggactaatctccattgaggctgcatctgacatcaagctcgaatcaagttgcaacttcgatctgcatacaactagcatggcccaaaaatcctttacccaggtagagtggagaaagaaatctgacacaaccgatactacaaatgcggcttcgaccacgttcgaggcccagactaagaccgtgaaccttaggggcacatgtattctggcaccagaattgtacgacactctcaagaaagtcaagaaaaccgtgctgtgctatgatctgacatgtaatcagacccactgccaaccgacggtttacctcatcgcccccgtgttaacttgtatgtcaatacggagctgcatggctagtgtctttacatcccgcatccaggtgatttatgagaagacccattgtgtaactggtcagctgatcgaagggcagtgcttcaaccctgcacacacacttaccttgtctcaaccagcccatacgtacgacaccgttacactgcccattagctgtttcttcactcctaaaaagtccgagcagctaaaggtgatcaaaacctttgagggaatactcacaaagactggctgcaccgaaaatgctctgcagggctactatgtctgcttccttgggtcacacagtgagccactgattgtgcccagcttggaagatatccgatctgccgaggtggtctcccgtatgctcgttcaccctagaggagaagaccatgatgcgattcagaactcacaaagccacctgaggatcgtgggtccaatcacagcaaaagtaccgagtacctcttccactgacacgttaaagggcacagcctttgctggggtgcccatgtacagctcgctgtctaccctcgtccggaatgccgatcctgagttcgtgttttccccaggaattgttcccgagtcaaaccatagtacttgtgacaaaaagaccgtgcctataacatggaccggctatcttccaatcagcggtgaaatggagaaagtcactgggtgcacagtgttctgtacgctggcaggacccggcgcttcctgcgaagcctactctgagaatggcatttttaacatcagctcaccgacctgtttggtaaataaggttcagcgcttcagagggagtgaacagaagataaacttcatttgccaaagggtggatcaggacgtcgtggtctattgtaatggacagaaaaaggtgatcctaactaaaacactggttatcggtcagtgcatttacacctttacatccctcttcagcctgatgcctgacgtggcgcactctcttgccgtagagctgtgtgtccccggcttgcacgggtgggcaactgtgatgctcctgtcaaccttttgcttcggatgggttttaatcccagctgtgacgctgattatactaaagtgtctccgggtcctgacctttagttgcagccattatacaaacgagtccaaattcaagtttatccttgaaaaggtgaaaattgagtaccaaaagactatgggctctatggtatgcgatgtgtgtcaccatgaatgcgagaccgccaaagaattggagtcgcaccgccagagctgtatcaatggtcagtgcccttactgtatgacaatcactgaggctaccgaatccgccctgcaggcacattattcaatttgcaagctcacggggcgattccaagaggccctgaaaaagagtcttaagaaacccgaagttaagaaaggctgttacagaacactgggagtctttaggtataagtctcggtgctacgtgggcttggtgtggtgtctcctgttaacctgcgagatagtcatctgggctgcgagcgcagagactccactgatggaatccgggtggtcagacacagcccacggagttggtgagattcccatgaaaaccgatctagaactcgacttcagcctgccttcttccagtagctattcttaccgtcgcaagctcactaacccagctaacaaggaggaatccatcccgtttcacttccagatggagaaacaggtgattcatgccgagatccagcccttgggccactggatggatgcaacctttaatataaagacagccttccattgttatggggcttgccaaaaatactcatacccttggcagacgagtaagtgcttctttgaaaaagactatcagtacgagaccggatggggctgtaacccaggtgattgccccggggtgggcactggatgtacagcctgcggcgtatatctggacaagctcaaaagcgtcgggaaggcatacaagatcatttcgctgaaatataccagaaaggtgtgtatccagttaggaacagaacaaacttgcaaacacattgatgcgaatgactgtctggttaccccttccgtgaaggtctgcatcgtgggtacggtttctaaacttcagccaagcgatacattgctctttctgggccccctagagcaagggggaataattctgaagcagtggtgtaccacttcatgcgcttttggcgacccgggtgacatcatgagtaccccttccgggatgaggtgtccagaacacacaggctctttccggaagatttgcggatttgccactacccccgtgtgcgagtaccagggcaacacaatcagcgggtataaacgaatgatggcaacgaaggattccttccagtcatttaatctcaccgagcctcatataactacaaacaaactggaatggatcgaccccgatggaaatacccgcgaccacgtaaaccttgtcttgaatagagatgtgagcttccaggacctgagtgataacccatgtaaggtggacttacatactcaagccattgagggcgcttggggttctggggtcggatttacacttacctgcacggttggcctgactgaatgtccttccttcatgaccagcatcaaagcctgcgatcttgcaatgtgttacggttcgacagtgaccaatctggctaggggctcaaacactgtaaaggtggtcgggaagggaggccactctgggagttcctttaaatgctgtcatgacacagattgcagctctgagggattgctcgccagcgcgccccacctggaacgggtgaccggcttcaatcagattgactccgataaggtttacgacgacggtgccccaccgtgtacatttaaatgctggttcactaagtcaggggagtggctactgggaatcctcaacggcaattggatagtggtcgtggttctggtggtcattcttatcttgagtatcattatgttcagcgtactgtgtcctcgcagaggtcacaaaaagaccgtgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16615 - RNA, 1504 nt, synthetic construct
  misc_feature 1..1504: note = mRNA product Design1 comprising derived and/or modified sequence from ANDV(Chile-9717869)__AF291702.1__N (opt1)
  source 1..1504: mol_type = other RNA
gggagaaagcttaccatgagcaccctgcaggagctccaggagaacatcaccgcccacgagcagcagctggtgacggcccgccagaagctgaaggacgcggagaaggccgtcgaggtggaccccgacgacgtgaacaagtccaccctccagagccggcgcgccgccgtctccaccctggagaccaagctgggcgagctcaagcggcagctggccgacctggtggcggcccagaagctcgccacgaagccggtggaccccaccgggctggagcccgacgaccacctgaaggagaagtccagcctccgctacggcaacgtcctggacgtgaacagcatcgacctggaggagccctccgggcagaccgccgactggaaggcgatcggcgcctacatcctcgggttcgccatcccgatcatcctgaaggccctgtacatgctcagcacccggggccgccagacggtgaaggacaacaagggcacccggatccgcttcaaggacgactccagcttcgaggaggtcaacgggatccggaagcccaagcacctgtacgtgtccatgcccaccgcccagagcaccatgaaggcggaggagatcacgcccggccgcttccggaccatcgcctgcgggctgttcccggcccaggtgaaggcccgcaacatcatctcccccgtcatgggcgtgatcgggttcggcttcttcgtgaaggactggatggaccggatcgaggagttcctcgccgcggagtgccccttcctgcccaagccgaaggtcgccagcgaggccttcatgtccaccaacaagatgtacttcctgaaccgccagcgccaggtgaacgagagcaaggtgcaggacatcatcgacctcatcgaccacgccgagaccgagtccgccacgctgttcaccgagatcgcgacgccccacagcgtctgggtgttcgcctgcgcccccgaccggtgcccgcccaccgccctgtacgtggccggcgtccccgagctcggggcgttcttctccatcctgcaggacatgcggaacaccatcatggccagcaagagcgtgggcaccgccgaggagaagctgaagaagaagtccgccttctaccagagctacctccgccggacccagtccatggggatccagctggaccagaagatcatcatcctgtacatgctcagctggggcaaggaggcggtgaaccacttccacctgggcgacgacatggaccccgagctgcgccagctcgcccagtccctgatcgacaccaaggtcaaggagatcagcaaccaggagcccctgaagctctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16616 - RNA, 3634 nt, synthetic construct
  misc_feature 1..3634: note = mRNA product Design1 comprising derived and/or modified sequence from ANDV(Chile-9717869)__AF291703.2__GP (opt1)
  source 1..3634: mol_type = other RNA
gggagaaagcttaccatggagggctggtacctggtggtcctcggggtgtgctacaccctgaccctggccatgcccaagacgatctacgagctcaagatggagtgcccgcacaccgtgggcctggggcagggctacatcatcgggagcaccgagctgggcctcatctccatcgaggccgccagcgacatcaagctggagtccagctgcaacttcgacctgcacaccacgtccatggcccagaagtccttcacccaggtcgagtggcgcaagaagtccgacaccaccgacacgaccaacgccgccagcaccaccttcgaggcccagacgaagaccgtgaacctccgggggacctgcatcctggcgcccgagctgtacgacaccctcaagaaggtgaagaagacggtcctgtgctacgacctgacctgcaaccagacccactgccagcccaccgtgtacctcatcgcccccgtgctgacgtgcatgagcatccgcagctgcatggcctccgtcttcaccagccggatccaggtgatctacgagaagacccactgcgtgaccgggcagctgatcgagggccagtgcttcaacccggcccacacgctcaccctgtcccagcccgcgcacacctacgacaccgtcacgctgcccatcagctgcttcttcacccccaagaagtccgagcagctcaaggtgatcaagaccttcgaggggatcctgaccaagacgggctgcaccgagaacgccctgcaggggtactacgtgtgcttcctcggcagccactccgagccgctgatcgtccccagcctggaggacatccgctccgccgaggtggtgagccggatgctcgtccacccccgcggcgaggaccacgacgccatccagaacagccagtcccacctccggatcgtggggcccatcaccgccaaggtgccgagcacctccagcacggacaccctgaagggcaccgcgttcgccggggtccccatgtactccagcctgtccaccctggtgcgcaacgccgaccccgagttcgtgttcagccccggcatcgtcccggagtccaaccacagcacgtgcgacaagaagaccgtgcccatcacctggaccggctacctgcccatctccggggagatggagaaggtcaccggctgcacggtgttctgcaccctcgccgggcccggcgccagctgcgaggcgtactccgagaacgggatcttcaacatcagctccccgacctgcctggtgaacaaggtccagcggttccgcggcagcgagcagaagatcaacttcatctgccagcgggtggaccaggacgtggtcgtgtactgcaacggccagaagaaggtgatcctgaccaagacgctcgtcatcgggcagtgcatctacaccttcacctccctgttcagcctgatgcccgacgtggcccactccctcgccgtggagctgtgcgtccccggcctgcacgggtgggccaccgtgatgctcctgagcacgttctgcttcggctgggtgctgatccccgccgtcaccctcatcatcctgaagtgcctgcgcgtgctcaccttcagctgctcccactacaccaacgagagcaagttcaagttcatcctggagaaggtgaagatcgagtaccagaagacgatggggtccatggtctgcgacgtgtgccaccacgagtgcgagaccgcgaaggagctggagagccaccggcagtcctgcatcaacggccagtgcccgtactgcatgaccatcaccgaggccacggagagcgccctgcaggcccactactccatctgcaagctcaccggccgcttccaggaggccctgaagaagtccctgaagaagcccgaggtgaagaaggggtgctaccggaccctcggcgtcttccgctacaagagccggtgctacgtggggctggtgtggtgcctgctcctgacctgcgagatcgtcatctgggcggccagcgccgagacgcccctgatggagtccggctggagcgacaccgcccacggggtgggcgagatccccatgaagaccgacctcgagctggacttctccctgccgagctccagctcctacagctaccgccggaagctcaccaaccccgcgaacaaggaggagagcatccccttccacttccagatggagaagcaggtcatccacgccgagatccagccgctgggccactggatggacgccacgttcaacatcaagaccgccttccactgctacggggcctgccagaagtactcctacccctggcagaccagcaagtgcttcttcgagaaggactaccagtacgagaccggctgggggtgcaaccccggcgactgccccggcgtggggacgggctgcaccgcgtgcggggtgtacctggacaagctcaagtccgtgggcaaggcctacaagatcatcagcctgaagtacacccgcaaggtctgcatccagctggggaccgagcagacgtgcaagcacatcgacgccaacgactgcctcgtgaccccgtccgtgaaggtctgcatcgtgggcaccgtgagcaagctgcagccctccgacaccctcctgttcctgggccccctggagcagggcggcatcatcctcaagcagtggtgcaccacgagctgcgccttcggggaccccggcgacatcatgtccaccccgagcgggatgcggtgccccgagcacaccggctccttccgcaagatctgcggcttcgccaccacgcccgtctgcgagtaccaggggaacaccatcagcggctacaagcgcatgatggcgaccaaggactccttccagagcttcaacctgaccgagccccacatcacgaccaacaagctggagtggatcgacccggacgggaacacccgggaccacgtgaacctcgtgctgaaccgcgacgtctccttccaggacctgagcgacaacccctgcaaggtggacctccacacccaggccatcgagggcgcctgggggtccggcgtgggcttcacgctgacctgcaccgtcgggctgaccgagtgccccagcttcatgacgtccatcaaggcctgcgacctcgccatgtgctacggcagcaccgtgaccaacctggcgcgggggagcaacaccgtgaaggtcgtgggcaagggcgggcactccggcagctccttcaagtgctgccacgacacggactgcagctccgaggggctgctcgccagcgcgccccacctggagcgcgtgaccggcttcaaccagatcgactccgacaaggtctacgacgacggggccccgccctgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagacggtctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16617 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (opt1)
  source 1..3634: mol_type = other RNA
gggagaaagcttaccatggactggacctggatcctgttcctcgtggccgccgcgacccgcgtccacagcatgcccaagacgatctacgagctcaagatggagtgcccgcacaccgtgggcctggggcagggctacatcatcgggagcaccgagctgggcctcatctccatcgaggccgccagcgacatcaagctggagtccagctgcaacttcgacctgcacaccacgtccatggcccagaagtccttcacccaggtcgagtggcgcaagaagtccgacaccaccgacacgaccaacgccgccagcaccaccttcgaggcccagacgaagaccgtgaacctccgggggacctgcatcctggcgcccgagctgtacgacaccctcaagaaggtgaagaagacggtcctgtgctacgacctgacctgcaaccagacccactgccagcccaccgtgtacctcatcgcccccgtgctgacgtgcatgagcatccgcagctgcatggcctccgtcttcaccagccggatccaggtgatctacgagaagacccactgcgtgaccgggcagctgatcgagggccagtgcttcaacccggcccacacgctcaccctgtcccagcccgcgcacacctacgacaccgtcacgctgcccatcagctgcttcttcacccccaagaagtccgagcagctcaaggtgatcaagaccttcgaggggatcctgaccaagacgggctgcaccgagaacgccctgcaggggtactacgtgtgcttcctcggcagccactccgagccgctgatcgtccccagcctggaggacatccgctccgccgaggtggtgagccggatgctcgtccacccccgcggcgaggaccacgacgccatccagaacagccagtcccacctccggatcgtggggcccatcaccgccaaggtgccgagcacctccagcacggacaccctgaagggcaccgcgttcgccggggtccccatgtactccagcctgtccaccctggtgcgcaacgccgaccccgagttcgtgttcagccccggcatcgtcccggagtccaaccacagcacgtgcgacaagaagaccgtgcccatcacctggaccggctacctgcccatctccggggagatggagaaggtcaccggctgcacggtgttctgcaccctcgccgggcccggcgccagctgcgaggcgtactccgagaacgggatcttcaacatcagctccccgacctgcctggtgaacaaggtccagcggttccgcggcagcgagcagaagatcaacttcatctgccagcgggtggaccaggacgtggtcgtgtactgcaacggccagaagaaggtgatcctgaccaagacgctcgtcatcgggcagtgcatctacaccttcacctccctgttcagcctgatgcccgacgtggcccactccctcgccgtggagctgtgcgtccccggcctgcacgggtgggccaccgtgatgctcctgagcacgttctgcttcggctgggtgctgatccccgccgtcaccctcatcatcctgaagtgcctgcgcgtgctcaccttcagctgctcccactacaccaacgagagcaagttcaagttcatcctggagaaggtgaagatcgagtaccagaagacgatggggtccatggtctgcgacgtgtgccaccacgagtgcgagaccgcgaaggagctggagagccaccggcagtcctgcatcaacggccagtgcccgtactgcatgaccatcaccgaggccacggagagcgccctgcaggcccactactccatctgcaagctcaccggccgcttccaggaggccctgaagaagtccctgaagaagcccgaggtgaagaaggggtgctaccggaccctcggcgtcttccgctacaagagccggtgctacgtggggctggtgtggtgcctgctcctgacctgcgagatcgtcatctgggcggccagcgccgagacgcccctgatggagtccggctggagcgacaccgcccacggggtgggcgagatccccatgaagaccgacctcgagctggacttctccctgccgagctccagctcctacagctaccgccggaagctcaccaaccccgcgaacaaggaggagagcatccccttccacttccagatggagaagcaggtcatccacgccgagatccagccgctgggccactggatggacgccacgttcaacatcaagaccgccttccactgctacggggcctgccagaagtactcctacccctggcagaccagcaagtgcttcttcgagaaggactaccagtacgagaccggctgggggtgcaaccccggcgactgccccggcgtggggacgggctgcaccgcgtgcggggtgtacctggacaagctcaagtccgtgggcaaggcctacaagatcatcagcctgaagtacacccgcaaggtctgcatccagctggggaccgagcagacgtgcaagcacatcgacgccaacgactgcctcgtgaccccgtccgtgaaggtctgcatcgtgggcaccgtgagcaagctgcagccctccgacaccctcctgttcctgggccccctggagcagggcggcatcatcctcaagcagtggtgcaccacgagctgcgccttcggggaccccggcgacatcatgtccaccccgagcgggatgcggtgccccgagcacaccggctccttccgcaagatctgcggcttcgccaccacgcccgtctgcgagtaccaggggaacaccatcagcggctacaagcgcatgatggcgaccaaggactccttccagagcttcaacctgaccgagccccacatcacgaccaacaagctggagtggatcgacccggacgggaacacccgggaccacgtgaacctcgtgctgaaccgcgacgtctccttccaggacctgagcgacaacccctgcaaggtggacctccacacccaggccatcgagggcgcctgggggtccggcgtgggcttcacgctgacctgcaccgtcgggctgaccgagtgccccagcttcatgacgtccatcaaggcctgcgacctcgccatgtgctacggcagcaccgtgaccaacctggcgcgggggagcaacaccgtgaaggtcgtgggcaagggcgggcactccggcagctccttcaagtgctgccacgacacggactgcagctccgaggggctgctcgccagcgcgccccacctggagcgcgtgaccggcttcaaccagatcgactccgacaaggtctacgacgacggggccccgccctgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagacggtctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16618 - RNA, 1504 nt, synthetic construct
  misc_feature 1..1504: note = mRNA product Design1 comprising derived and/or modified sequence from ANDV(Chile-9717869)__AF291702.1__N (opt5)
  source 1..1504: mol_type = other RNA
gggagaaagcttaccatgagcaccctgcaggagctccaagaaaacatcacagcccacgagcagcagctggtgacggctagacagaaacttaaggacgccgaaaaggcggtcgaggttgatcccgacgatgtgaataaatccaccctgcaatctcggcgcgctgccgtgagcacactcgaaaccaagctgggcgagcttaaaagacagctggccgacctcgtcgctgcccagaagctggctacaaagcctgtggatccgaccgggctggagcccgacgatcatctcaaagaaaagtcctctctgcggtacggaaacgttcttgacgtgaatagcattgatctggaggaaccttccggccagacagccgactggaaagcgatcggggcctatattctcggattcgctatccccattatcctgaaggccctttacatgctgtctacccgcggcagacaaacggtcaaagataacaaggggacccggatccgctttaaggacgatagctccttcgaggaggtgaatggaattagaaaacctaagcacctctatgttagcatgcccacagctcagtctaccatgaaagccgaagagatcacacctggccggtttcgcaccattgcgtgcggcctgttcccggcccaggtgaaggctagaaacatcatttcccccgtcatgggggtgatcggatttggcttctttgtgaaagactggatggaccggattgaagagttcctggccgctgaatgtccttttctccccaagcctaaagtcgccagcgaggccttcatgtctacgaataagatgtactttctgaaccgccagagacaagttaatgagtccaaggtgcaggatatcatcgaccttattgatcatgctgaaacagagagcgcgaccctgttcacagaaatcgccacaccccactctgtgtgggtctttgcttgcgccccggaccggtgtcctcccaccgccctctatgtggctggggttcctgagctgggagccttcttctccattcttcaggatatgcgcaacaccatcatggcgagcaaatccgtgggcacggctgaagagaagctgaaaaagaaatctgccttttaccaaagctatctcagacggacccagtccatggggattcagctggaccagaagatcatcattctgtacatgctcagctggggaaaggaggccgtcaatcatttccacctgggcgatgacatggatcccgaacttagacaactggctcagtctctcatcgacacaaaagtgaaggagatttccaaccaggaacccctgaaactttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16619 - RNA, 3634 nt, synthetic construct
  misc_feature 1..3634: note = mRNA product Design1 comprising derived and/or modified sequence from ANDV(Chile-9717869)__AF291703.2__GP (opt5)
  source 1..3634: mol_type = other RNA
gggagaaagcttaccatggagggctggtacctggtggtcctcggggtttgctataccctgacacttgccatgcccaagacgatctacgaactgaaaatggagtgtcctcacaccgtgggactcggccaggggtatattatcggaagcacagaactgggccttatttccatcgaggctgcctctgacattaagctggaaagctcctgcaacttcgatctccataccacatctatggcgcaaaagagctttacccaggtggagtggagaaagaaatccgacacaaccgatacgaccaatgctgcctctacaaccttcgaggcccagacaaagaccgtcaacctgcgggggacgtgtatcctggctccggaactctacgacacactgaagaaagtgaagaaaaccgttctttgctatgatctgacatgtaatcagacccactgccaacccaccgtgtacctcatcgcccctgtcctgacatgtatgagcattcgctcctgcatggctagcgtgtttacgtctagaatccaggttatttatgagaagacccattgtgtgacaggacagcttatcgaaggccagtgcttcaaccccgcccacaccctgacactctcccaacctgcgcatacctacgacacggtcacactgcccattagctgctttttcacccctaaaaagtctgagcagctgaaggtgatcaaaacctttgagggcattctcacaaagaccgggtgcacagaaaatgccctgcagggatactatgtgtgcttccttggctcccacagcgagccgctgatcgtcccctctctcgaagatatccggtccgctgaggttgtgagccgcatgctggtgcaccctagaggggaagaccatgatgccattcagaactcccaatctcaccttcggatcgtcggacccattacggctaaagtgcctagcacctccagcacagacaccctgaagggcacagcctttgcgggggttcccatgtactcttccctcagcaccctggtgcgcaatgccgatccggagttcgtcttttctcctggaatcgtgcccgagagcaaccattccacgtgtgacaaaaagaccgttcctattacatggaccggctatctgcccatctctggcgaaatggagaaagtgacagggtgcaccgtcttctgtacgctcgctggacccggcgccagctgcgaagcctactccgagaatgggatctttaacattagctctcctacatgtctggtgaataaggtccagagattccggggatccgaacagaagatcaacttcatttgccaacgcgtggatcaggacgttgtggtctattgtaatggccagaaaaaggtgatccttaccaaaacactggttattgggcagtgcatctacacctttaccagcctcttctctctgatgccggacgtggcccactcccttgccgtcgagctgtgtgtgcccggactccacggctgggctacagtgatgctgctgagcacgttttgcttcggctgggttctcatccctgcggtcaccctgattatccttaagtgtctgagagtgctcacattttcctgctctcattataccaacgagagcaaattcaagtttattctggaaaaggtgaaaatcgagtaccaaaagacaatggggtccatggtctgcgatgtgtgtcaccatgaatgcgagaccgccaaagaactggagtctcaccggcagagctgtattaatggacagtgcccctactgtatgacgatcacagaggctaccgaatccgcccttcaggcccattatagcatttgcaagctcaccggccgcttccaagaggctctgaaaaagtctctgaagaaacctgaagttaagaaagggtgttacagaacactcggagtgtttcggtataagtcccgctgctacgtcggcctggtgtggtgtcttctgctcacctgtgagatcgttatctgggccgcgagcgctgagacacccctgatggaatctgggtggtccgacacggcccacggcgtgggagagattccgatgaaaaccgatctggaacttgacttcagcctcccttctagctccagctattcttacagacggaagctgacaaaccccgccaacaaggaggaatccatcccttttcacttccagatggagaaacaggtcattcatgctgagatccagcccctgggccactggatggatgccacctttaatattaagacagctttccattgttatggggcctgccaaaaatacagctacccttggcagacctccaagtgcttctttgaaaaagactatcagtacgagacgggatggggctgtaaccccggggattgcccgggagtgggcaccgggtgtacagcgtgcggcgtttatctcgacaagctgaaatctgtgggaaaggcctacaagatcatcagccttaaatataccagaaaggtctgtattcagctgggcacagaacaaacctgcaaacacatcgatgctaatgactgtctcgtgacaccttccgtgaaggtctgcattgttgggaccgtgtctaaactgcagcccagcgatacgctgcttttcctcggacccctggagcagggcgggatcattctgaagcaatggtgtacaacctcctgcgcctttggagaccctggcgacatcatgtctaccccgagcgggatgcgctgtcccgaacacacaggctccttccggaagatctgcggatttgctaccacgcctgtgtgcgagtaccagggcaacacaattagcgggtataaaagaatgatggccaccaaggattctttccagtcctttaatctcacagagccccatatcaccacaaacaaactggaatggattgaccctgatggaaatacccgcgaccacgtcaaccttgtgctgaatcgggatgttagcttccaggacctctctgataacccctgtaaggtggacctgcatacgcaagcgatcgagggcgcctgggggtccggagtcggctttaccctgacatgcaccgtggggcttacagaatgtcctagcttcatgacctctattaaggcttgcgatctcgccatgtgttacggctccacggttacaaatctggctagaggaagcaacaccgtgaaagtcgtgggcaaagggggacactccggcagctcttttaaatgctgtcatgacacagattgcagctccgaggggctgctcgcctctgctccccacctggaacgcgttaccggattcaatcagatcgacagcgataaggtgtacgacgacggcgctccgccttgtacctttaaatgctggttcacaaagtccggcgagtggcttctggggatcctcaacggaaattggattgtcgtggtggtcctggttgtgatcctgattctttctatcattatgttcagcgtgctgtgtccccggagaggccacaaaaagacggtctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16620 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (opt5)
  source 1..3634: mol_type = other RNA
gggagaaagcttaccatggactggacctggatcctgttcctcgtggccgctgccacaagagtccacagcatgcccaagacgatctacgaactgaaaatggagtgtcctcacaccgtgggactcggccaggggtatattatcggaagcacagaactgggccttatttccatcgaggctgcctctgacattaagctggaaagctcctgcaacttcgatctccataccacatctatggcgcaaaagagctttacccaggtggagtggagaaagaaatccgacacaaccgatacgaccaatgctgcctctacaaccttcgaggcccagacaaagaccgtcaacctgcgggggacgtgtatcctggctccggaactctacgacacactgaagaaagtgaagaaaaccgttctttgctatgatctgacatgtaatcagacccactgccaacccaccgtgtacctcatcgcccctgtcctgacatgtatgagcattcgctcctgcatggctagcgtgtttacgtctagaatccaggttatttatgagaagacccattgtgtgacaggacagcttatcgaaggccagtgcttcaaccccgcccacaccctgacactctcccaacctgcgcatacctacgacacggtcacactgcccattagctgctttttcacccctaaaaagtctgagcagctgaaggtgatcaaaacctttgagggcattctcacaaagaccgggtgcacagaaaatgccctgcagggatactatgtgtgcttccttggctcccacagcgagccgctgatcgtcccctctctcgaagatatccggtccgctgaggttgtgagccgcatgctggtgcaccctagaggggaagaccatgatgccattcagaactcccaatctcaccttcggatcgtcggacccattacggctaaagtgcctagcacctccagcacagacaccctgaagggcacagcctttgcgggggttcccatgtactcttccctcagcaccctggtgcgcaatgccgatccggagttcgtcttttctcctggaatcgtgcccgagagcaaccattccacgtgtgacaaaaagaccgttcctattacatggaccggctatctgcccatctctggcgaaatggagaaagtgacagggtgcaccgtcttctgtacgctcgctggacccggcgccagctgcgaagcctactccgagaatgggatctttaacattagctctcctacatgtctggtgaataaggtccagagattccggggatccgaacagaagatcaacttcatttgccaacgcgtggatcaggacgttgtggtctattgtaatggccagaaaaaggtgatccttaccaaaacactggttattgggcagtgcatctacacctttaccagcctcttctctctgatgccggacgtggcccactcccttgccgtcgagctgtgtgtgcccggactccacggctgggctacagtgatgctgctgagcacgttttgcttcggctgggttctcatccctgcggtcaccctgattatccttaagtgtctgagagtgctcacattttcctgctctcattataccaacgagagcaaattcaagtttattctggaaaaggtgaaaatcgagtaccaaaagacaatggggtccatggtctgcgatgtgtgtcaccatgaatgcgagaccgccaaagaactggagtctcaccggcagagctgtattaatggacagtgcccctactgtatgacgatcacagaggctaccgaatccgcccttcaggcccattatagcatttgcaagctcaccggccgcttccaagaggctctgaaaaagtctctgaagaaacctgaagttaagaaagggtgttacagaacactcggagtgtttcggtataagtcccgctgctacgtcggcctggtgtggtgtcttctgctcacctgtgagatcgttatctgggccgcgagcgctgagacacccctgatggaatctgggtggtccgacacggcccacggcgtgggagagattccgatgaaaaccgatctggaacttgacttcagcctcccttctagctccagctattcttacagacggaagctgacaaaccccgccaacaaggaggaatccatcccttttcacttccagatggagaaacaggtcattcatgctgagatccagcccctgggccactggatggatgccacctttaatattaagacagctttccattgttatggggcctgccaaaaatacagctacccttggcagacctccaagtgcttctttgaaaaagactatcagtacgagacgggatggggctgtaaccccggggattgcccgggagtgggcaccgggtgtacagcgtgcggcgtttatctcgacaagctgaaatctgtgggaaaggcctacaagatcatcagccttaaatataccagaaaggtctgtattcagctgggcacagaacaaacctgcaaacacatcgatgctaatgactgtctcgtgacaccttccgtgaaggtctgcattgttgggaccgtgtctaaactgcagcccagcgatacgctgcttttcctcggacccctggagcagggcgggatcattctgaagcaatggtgtacaacctcctgcgcctttggagaccctggcgacatcatgtctaccccgagcgggatgcgctgtcccgaacacacaggctccttccggaagatctgcggatttgctaccacgcctgtgtgcgagtaccagggcaacacaattagcgggtataaaagaatgatggccaccaaggattctttccagtcctttaatctcacagagccccatatcaccacaaacaaactggaatggattgaccctgatggaaatacccgcgaccacgtcaaccttgtgctgaatcgggatgttagcttccaggacctctctgataacccctgtaaggtggacctgcatacgcaagcgatcgagggcgcctgggggtccggagtcggctttaccctgacatgcaccgtggggcttacagaatgtcctagcttcatgacctctattaaggcttgcgatctcgccatgtgttacggctccacggttacaaatctggctagaggaagcaacaccgtgaaagtcgtgggcaaagggggacactccggcagctcttttaaatgctgtcatgacacagattgcagctccgaggggctgctcgcctctgctccccacctggaacgcgttaccggattcaatcagatcgacagcgataaggtgtacgacgacggcgctccgccttgtacctttaaatgctggttcacaaagtccggcgagtggcttctggggatcctcaacggaaattggattgtcgtggtggtcctggttgtgatcctgattctttctatcattatgttcagcgtgctgtgtccccggagaggccacaaaaagacggtctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16621 - RNA, 1504 nt, synthetic construct
  misc_feature 1..1504: note = mRNA product Design1 comprising derived and/or modified sequence from ANDV(Chile-9717869)__AF291702.1__N (opt11)
  source 1..1504: mol_type = other RNA
gggagaaagcttaccatgtccaccctccaagaactccaagaaaacatcacagcacacgagcaacaactcgtaactgcccgtcaaaaactcaaagacgcggaaaaagccgtcgaagtcgaccccgacgacgtcaataaatccaccctccaatcacgccgcgccgcagtcagcaccctcgaaaccaaactcggcgaactcaaacgacaactagccgacctcgtagcagcccaaaaactcgcaaccaaacccgtagaccccaccggactagaacccgacgaccacctcaaagaaaaatcctccctaagatacggcaacgtcctcgacgtcaacagcatcgacctagaggaaccaagcggccaaacagcagactggaaagccatcggcgcctacatcctaggattcgccatcccaatcatactcaaagccctctacatgctttccacacgcggacgccaaacggttaaagacaacaaaggcacacgaataagatttaaagacgacagctccttcgaagaagtcaacggcatccgcaaacccaaacacctctacgtatcaatgcccaccgcccaatccaccatgaaagccgaagaaatcacacccggccgattcagaacaatcgcctgcggactcttcccggcccaagtcaaagcccgaaacatcatatcccccgtcatgggagtcatcggcttcggcttcttcgtcaaagactggatggaccgcatcgaagagttcctcgccgccgaatgcccattcttaccaaaaccgaaagtcgcctccgaggctttcatgtctacgaacaaaatgtacttcctcaacagacaacgccaagtcaacgaatcaaaagtccaagacataatcgacttaatcgaccatgcagaaacagaatccgccaccctcttcaccgaaatagccacaccccacagcgtctgggtcttcgcctgcgcccccgaccgatgcccaccaaccgccctatatgtagccggcgtacccgaactcggcgccttcttctcaatcctccaagacatgaggaacaccatcatggcatccaaatcagtaggcaccgccgaagaaaagctaaagaagaaaagcgcattctaccaaagctacctacgacgcacccaatcaatgggaatccaactcgaccagaaaatcataatcctatacatgctctcctggggaaaagaagcagtaaaccacttccacctaggcgacgacatggaccccgaactccgccaactcgcccaatcactcatcgacactaaagtaaaagagatatccaaccaagaaccactcaaactataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16622 - RNA, 3634 nt, synthetic construct
  misc_feature 1..3634: note = mRNA product Design1 comprising derived and/or modified sequence from ANDV(Chile-9717869)__AF291703.2__GP (opt11)
  source 1..3634: mol_type = other RNA
gggagaaagcttaccatggaggggtggtacttagtcgtattgggagtctgctacacactgacacttgccatgccaaaaacaatttacgaactcaagatggaatgtccccacaccgtcggcctaggccaaggctacattatcggttctactgaactgggactaatttccatagaagcggcatctgacatcaaactcgagagcagctgcaacttcgaccttcacacaacttccatggcccagaaatctttcacgcaggtcgaatggcgcaagaaatcagacacaacggacaccacaaacgcggcctcaaccacctttgaagcccaaaccaaaaccgtaaacctacgaggaacctgtatcctcgcacccgagctttacgacaccctcaagaaagtcaaaaagaccgtactctgctacgacctaacctgcaatcagacacactgccaaccaaccgtatatctaatcgctcccgtattaacatgcatgtccatccgaagctgcatggcatcagtcttcaccagcagaatacaagtaatctatgaaaagacccactgtgtcacaggccaattaatcgaaggccagtgcttcaatccagcccacaccctcaccctatcacaacccgcccacacctacgatacagtcacacttcccatatcctgcttcttcacacccaagaaatccgagcaactcaaagtgatcaaaacctttgagggcattctgaccaaaaccggctgtaccgagaacgcgctccaaggctattacgtgtgttttctaggcagtcactccgaaccactgatcgtaccatccctcgaagacatccggtcggccgaagtagtctcccgcatgctcgttcacccacgaggcgaagaccacgacgctatccaaaactcacaatcccatctgcgcatcgtcggaccaataaccgcgaaggtcccgtcaacgtcgtccaccgacacactcaaaggcaccgcctttgccggcgtacccatgtactcctccctatccacgctcgtccgaaatgccgaccccgagttcgtattctcaccaggcatagtaccggaaagcaaccactccacgtgcgacaagaaaacggtccccatcacttggaccggctacctgccaatctcaggggaaatggaaaaagtcaccggttgcactgttttctgcactctagcaggcccaggcgcaagctgcgaagcctactcagaaaacggcatattcaacattagcagcccaacatgtctcgtaaacaaagtacaacgctttcgaggctccgaacagaaaataaacttcatatgccaaagggtcgaccaagacgtcgtagtctactgcaacggccaaaagaaagtaatcctcaccaaaacactcgtcatcggacagtgcatctacacatttacctcactattcagcctcatgccagatgtcgcgcactcccttgcagtggagctctgcgtaccagggctacacggctgggccaccgtaatgcttctatccacattttgcttcgggtgggtcctaattcccgccgtcaccctgatcatactaaaatgcctccgagtcctcactttctcgtgctcacactacacaaacgaatccaaattcaaattcatactcgaaaaagtaaaaatagaataccagaaaacgatgggatcaatggtatgcgacgtatgtcaccacgagtgtgagaccgccaaagaacttgaatcgcaccgccaatcctgcatcaacggacaatgcccatactgcatgaccataacagaagcaaccgaaagcgccctccaagcccactactcaatctgcaaactgaccggaaggttccaggaagcccttaagaaatccctaaagaaacccgaggtaaagaaaggctgctaccgcacgctcggagtcttccgatacaaatctcgctgttacgtaggcctagtctggtgcctactcctaacctgcgaaatagtcatctgggcggcctcggccgaaaccccgctcatggaatccggctggtccgacaccgcccacggagtcggagaaataccaatgaaaacagacctcgaactcgacttctctctaccctcctcctcaagctacagctaccgccgcaaacttaccaaccccgccaataaagaagaaagtatcccatttcacttccaaatggagaaacaagtaattcacgccgaaatccagcctctcggccactggatggacgcaaccttcaacatcaaaacagcgttccactgctacggcgcctgccaaaaatacagctacccctggcagacctccaaatgtttcttcgagaaagactaccaatacgaaacagggtggggctgtaaccccggcgactgcccaggagtcggtacaggctgtactgcctgtggcgtctacctcgacaaactaaaatctgtaggcaaagcatacaaaatcatcagcctgaaatacacacgcaaagtatgtatccaactaggaacagaacaaacgtgcaaacacattgatgccaacgactgccttgtgacaccctccgtcaaagtatgcatcgttggaaccgtatccaaactccaaccctccgacaccctcctatttcttggtcccctagaacaagggggcatcatccttaaacaatggtgcaccacctcctgcgcattcggagacccaggcgacataatgtcaaccccaagcggaatgcgatgtccagagcacacaggctcctttcgcaaaatatgcggcttcgcaaccacaccggtctgcgaataccaaggcaacacaatctccggctacaaaagaatgatggccacgaaagactccttccaatcgttcaacctcaccgaaccccatatcacaaccaacaaactcgagtggattgaccccgacggcaacacccgcgaccacgtcaacctcgtcctcaaccgtgacgtatcgttccaagacctcagcgacaacccctgcaaagtcgacctacacacacaggcgatcgaaggcgcttggggtagcggcgtcggcttcacactaacctgcaccgttggactcaccgaatgcccttccttcatgacttccatcaaggcatgcgacctcgccatgtgctacggctccaccgtcacaaacctggccagaggatccaacaccgtaaaagttgtaggaaaaggcggccactcaggaagcagctttaaatgctgccacgacaccgattgctcctctgaaggcctacttgcctccgcgccacacctagaacgcgtaaccgggttcaaccagatagacagcgacaaggtgtacgacgacggcgcgcctccatgcactttcaaatgctggttcacaaaatcaggagaatggctcttaggcatactcaacggcaattggatagtagtcgtcgtcctagtagtaatactgatcttatctatcatcatgttctcagttctttgccccagacgggggcacaagaagacagtctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16623 - RNA, 3634 nt, synthetic construct
  misc_feature 1..3634: note = mRNA product Design1 comprising derived and/or modified sequence from ANDV(Chile-9717869)__AF291703.2__IgE-leader_Gn-Gc (opt11)
  source 1..3634: mol_type = other RNA
gggagaaagcttaccatggattggacgtggatactctttctcgtggccgcggccacgcgcgtgcactcgatgccaaaaacaatttacgaactcaagatggaatgtccccacaccgtcggcctaggccaaggctacattatcggttctactgaactgggactaatttccatagaagcggcatctgacatcaaactcgagagcagctgcaacttcgaccttcacacaacttccatggcccagaaatctttcacgcaggtcgaatggcgcaagaaatcagacacaacggacaccacaaacgcggcctcaaccacctttgaagcccaaaccaaaaccgtaaacctacgaggaacctgtatcctcgcacccgagctttacgacaccctcaagaaagtcaaaaagaccgtactctgctacgacctaacctgcaatcagacacactgccaaccaaccgtatatctaatcgctcccgtattaacatgcatgtccatccgaagctgcatggcatcagtcttcaccagcagaatacaagtaatctatgaaaagacccactgtgtcacaggccaattaatcgaaggccagtgcttcaatccagcccacaccctcaccctatcacaacccgcccacacctacgatacagtcacacttcccatatcctgcttcttcacacccaagaaatccgagcaactcaaagtgatcaaaacctttgagggcattctgaccaaaaccggctgtaccgagaacgcgctccaaggctattacgtgtgttttctaggcagtcactccgaaccactgatcgtaccatccctcgaagacatccggtcggccgaagtagtctcccgcatgctcgttcacccacgaggcgaagaccacgacgctatccaaaactcacaatcccatctgcgcatcgtcggaccaataaccgcgaaggtcccgtcaacgtcgtccaccgacacactcaaaggcaccgcctttgccggcgtacccatgtactcctccctatccacgctcgtccgaaatgccgaccccgagttcgtattctcaccaggcatagtaccggaaagcaaccactccacgtgcgacaagaaaacggtccccatcacttggaccggctacctgccaatctcaggggaaatggaaaaagtcaccggttgcactgttttctgcactctagcaggcccaggcgcaagctgcgaagcctactcagaaaacggcatattcaacattagcagcccaacatgtctcgtaaacaaagtacaacgctttcgaggctccgaacagaaaataaacttcatatgccaaagggtcgaccaagacgtcgtagtctactgcaacggccaaaagaaagtaatcctcaccaaaacactcgtcatcggacagtgcatctacacatttacctcactattcagcctcatgccagatgtcgcgcactcccttgcagtggagctctgcgtaccagggctacacggctgggccaccgtaatgcttctatccacattttgcttcgggtgggtcctaattcccgccgtcaccctgatcatactaaaatgcctccgagtcctcactttctcgtgctcacactacacaaacgaatccaaattcaaattcatactcgaaaaagtaaaaatagaataccagaaaacgatgggatcaatggtatgcgacgtatgtcaccacgagtgtgagaccgccaaagaacttgaatcgcaccgccaatcctgcatcaacggacaatgcccatactgcatgaccataacagaagcaaccgaaagcgccctccaagcccactactcaatctgcaaactgaccggaaggttccaggaagcccttaagaaatccctaaagaaacccgaggtaaagaaaggctgctaccgcacgctcggagtcttccgatacaaatctcgctgttacgtaggcctagtctggtgcctactcctaacctgcgaaatagtcatctgggcggcctcggccgaaaccccgctcatggaatccggctggtccgacaccgcccacggagtcggagaaataccaatgaaaacagacctcgaactcgacttctctctaccctcctcctcaagctacagctaccgccgcaaacttaccaaccccgccaataaagaagaaagtatcccatttcacttccaaatggagaaacaagtaattcacgccgaaatccagcctctcggccactggatggacgcaaccttcaacatcaaaacagcgttccactgctacggcgcctgccaaaaatacagctacccctggcagacctccaaatgtttcttcgagaaagactaccaatacgaaacagggtggggctgtaaccccggcgactgcccaggagtcggtacaggctgtactgcctgtggcgtctacctcgacaaactaaaatctgtaggcaaagcatacaaaatcatcagcctgaaatacacacgcaaagtatgtatccaactaggaacagaacaaacgtgcaaacacattgatgccaacgactgccttgtgacaccctccgtcaaagtatgcatcgttggaaccgtatccaaactccaaccctccgacaccctcctatttcttggtcccctagaacaagggggcatcatccttaaacaatggtgcaccacctcctgcgcattcggagacccaggcgacataatgtcaaccccaagcggaatgcgatgtccagagcacacaggctcctttcgcaaaatatgcggcttcgcaaccacaccggtctgcgaataccaaggcaacacaatctccggctacaaaagaatgatggccacgaaagactccttccaatcgttcaacctcaccgaaccccatatcacaaccaacaaactcgagtggattgaccccgacggcaacacccgcgaccacgtcaacctcgtcctcaaccgtgacgtatcgttccaagacctcagcgacaacccctgcaaagtcgacctacacacacaggcgatcgaaggcgcttggggtagcggcgtcggcttcacactaacctgcaccgttggactcaccgaatgcccttccttcatgacttccatcaaggcatgcgacctcgccatgtgctacggctccaccgtcacaaacctggccagaggatccaacaccgtaaaagttgtaggaaaaggcggccactcaggaagcagctttaaatgctgccacgacaccgattgctcctctgaaggcctacttgcctccgcgccacacctagaacgcgtaaccgggttcaaccagatagacagcgacaaggtgtacgacgacggcgcgcctccatgcactttcaaatgctggttcacaaaatcaggagaatggctcttaggcatactcaacggcaattggatagtagtcgtcgtcctagtagtaatactgatcttatctatcatcatgttctcagttctttgccccagacgggggcacaagaagacagtctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16624 - RNA, 1669 nt, synthetic construct
  misc_feature 1..1669: note = mRNA product Design2 comprising derived and/or modified sequence from ANDV(Chile-9717869)__AF291702.1__N (wt)
  source 1..1669: mol_type = other RNA
ggggcgctgcctacggaggtggcagccatctccttctcggcatcaagcttaccatgagcaccctccaagaattgcaggaaaacatcacagcacacgaacaacagctcgtgactgctcggcaaaagcttaaggatgccgagaaggcagtggaggtggacccggatgacgttaacaagagcacactacaaagtagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacacctttacgtctcaatgccaactgcacagtccactatgaaggctgaagaaatcacgccaggacgatttaggacaattgcttgtggcctttttccagcacaggtcaaagcccgaaatataataagtcctgtaatgggagtaattggatttggcttctttgtaaaggattggatggatcggatagaagagtttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccattcagtctgggtgtttgcatgtgcacctgaccggtgccctccaactgcattgtatgttgcaggggtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16625 - RNA, 1669 nt, synthetic construct
  misc_feature 1..1669: note = mRNA product Design2 comprising derived and/or modified sequence from ANDV(Chile-9717869)__AF291702.1__N (wt)
  source 1..1669: mol_type = other RNA
ggggcgctgcctacggaggtggcagccatctccttctcggcatcaagcttaccatgagcaccctccaagaattgcaggaaaacatcacagcacacgaacaacagctcgtgactgctcggcaaaagctgaaggatgccgagaaggcagtggaggtggacccggatgacgttaacaagagcacactacaaagtagacgggcagctgtgtctacattggagaccaaactcggagaacttaagaggcaacttgcagatttggtggcagctcaaaaattggctacaaaaccagttgatccaacagggcttgagcctgatgatcatctaaaggaaaaatcatctctgagatatgggaatgtcctggatgttaattcaattgatttggaagaaccgagtggacagactgctgattggaaggctataggagcatacatcttagggtttgcaattccgatcatcctaaaggccttatacatgctgtcaacccgtgggagacaaactgtgaaagacaacaaagggaccaggataaggtttaaggatgattcttcctttgaagaagtcaatgggatacgtaaaccaaaacacctttacgtctcaatgccaactgcacagtccactatgaaggctgaagaaatcacgccaggacgatttaggacaattgcttgtggcctttttccagcacaggtcaaagcccgaaatataataagtcctgtaatgggagtaattggatttggcttctttgtaaaggattggatggatcggatagaagagtttctggctgcagagtgtccattcttacctaagccaaaggtcgcctcagaagccttcatgtctaccaataagatgtattttctgaacagacagagacaagtcaatgaatctaaggttcaagatattatcgatttgatagaccatgctgagaccgagtctgctaccttgtttacagagattgcaacaccccattcagtctgggtgtttgcatgtgcacctgaccggtgccctccaactgcattgtatgttgcaggggtaccggaacttggtgcatttttttctatccttcaggacatgcgtaataccatcatggcatctaaatctgtagggactgcagaagagaagctaaagaaaaaatctgccttctaccaatcatacctaagaaggacacaatctatgggaatccaactggaccagaagatcataatcctttacatgctatcatggggtaaagaagctgtgaatcacttccatcttggtgatgatatggaccctgaactcaggcagctagcacaatctctgatcgatactaaggtgaaggagatctccaaccaagagccacttaagttgtagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16626 - RNA, 3799 nt, synthetic construct
  misc_feature 1..3799: note = mRNA product Design2 comprising derived and/or modified sequence from ANDV(Chile-9717869)__AF291703.2__GP (wt)
  source 1..3799: mol_type = other RNA
ggggcgctgcctacggaggtggcagccatctccttctcggcatcaagcttaccatggaagggtggtatctggttgttcttggagtctgctatacgctgacactggcaatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaattctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttaagaatagtgggacctatcacagcaaaagtgccatcaactagttccacagataccctaaaggggacagcctttgcaggcgtcccaatgtatagctctttatctacactagtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagcttgaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16627 - RNA, 3799 nt, synthetic construct
  misc_feature 1..3799: note = mRNA product Design2 comprising derived and/or modified sequence from ANDV(Chile-9717869)__AF291703.2__GP (wt)
  source 1..3799: mol_type = other RNA
ggggcgctgcctacggaggtggcagccatctccttctcggcatcaagcttaccatggaagggtggtatctggttgttcttggagtctgctatacgctgacactggcaatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaatcctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaactcacaaagtcacttaagaatagtgggacctatcacagcaaaagtgccatcaacaagttccacagataccctaaaggggacagcctttgcaggcgtcccaatgtatagctctttatctacacttgtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagctggaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16628 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (wt)
  source 1..3799: mol_type = other RNA
ggggcgctgcctacggaggtggcagccatctccttctcggcatcaagcttaccatggactggacctggatcctgttcctcgtggccgccgcgacccgcgtccacagcatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaattctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaattcacaaagtcacttaagaatagtgggacctatcacagcaaaagtgccatcaactagttccacagataccctaaaggggacagcctttgcaggcgtcccaatgtatagctctttatctacactagtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagcttgaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16629 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (wt)
  source 1..3799: mol_type = other RNA
ggggcgctgcctacggaggtggcagccatctccttctcggcatcaagcttaccatggactggacctggatcctgttcctcgtggccgccgcgacccgcgtccacagcatgcccaagaccatttatgagcttaaaatggaatgcccgcacactgtgggtctcggtcaaggttacatcattggctcaacagaactaggtttgatctcaattgaggctgcatctgatataaagctcgagagctcttgcaattttgatcttcatacaacatctatggcccagaagagtttcacccaagttgaatggagaaagaaaagtgacacaactgataccacaaatgctgcgtccactacctttgaagcacaaactaaaactgttaaccttagagggacttgtatactggcacctgaactctatgatacattgaagaaagtaaaaaagacagtcctgtgctatgatctaacatgtaatcaaacacattgtcagccaactgtctatctgattgcacctgtattgacatgcatgtcaataagaagttgtatggctagtgtgtttacaagcaggattcaggtgatttatgaaaagacacattgtgtaacaggtcagctgattgagggtcagtgtttcaacccagcacacacattgacattatctcagcctgctcacacttatgatactgtcacccttcctatctcttgttttttcacaccaaagaagtcggagcaactaaaagttataaaaacatttgaaggaatcctgacgaagacaggttgcacggagaatgcattgcagggttattatgtgtgttttttagggagtcattcagaacctttaattgttccgagtttggaggacatacggtctgctgaagttgttagtaggatgcttgtacaccctaggggagaagaccatgatgccatacagaactcacaaagtcacttaagaatagtgggacctatcacagcaaaagtgccatcaacaagttccacagataccctaaaggggacagcctttgcaggcgtcccaatgtatagctctttatctacacttgtcagaaatgcagacccagaatttgtattttctccaggtatagtacctgaatctaatcacagtacatgtgataagaagacagtacctatcacatggacaggctacctaccaatatcaggtgagatggaaaaagtgactggatgtacagttttttgtacactagcaggacctggtgctagttgtgaggcctattctgaaaatggtatatttaacatcagttctccaacatgtcttgtaaacaaagtccaaagatttcgtggatctgaacagaaaataaattttatctgtcagcgggtagatcaggatgttgttgtatactgcaatgggcaaaagaaagtcatattaaccaaaactttggttattgggcagtgtatttatacattcacaagcctattttcattgatgcctgatgtagcccactcattggctgtagaattatgtgtcccgggattacatggatgggccactgtcatgcttctatcaacattctgctttgggtgggtcttgattcctgcggtcacattaataatattaaagtgtctaagggttttgacgttttcttgttcccattacactaatgagtcaaaatttaaattcatcctggaaaaagttaaaattgaataccaaaagactatgggatcaatggtgtgcgatgtatgtcatcatgagtgtgaaacagcaaaagaacttgaatcacatagacagagttgtatcaatggacaatgtccttattgcatgacaataactgaagcaactgaaagtgccttgcaagcccattattccatttgtaaattgacaggaagatttcaggaggcactgaaaaagtcacttaaaaagccagaggtaaaaaaaggttgttacagaacactcggggtatttagatataaaagtagatgttatgtgggtttggtatggtgcctattgttgacatgtgaaattgttatttgggccgcaagtgcagagactccactaatggagtcaggctggtcagatacggctcatggtgttggtgagattccaatgaagacagacctcgagctggacttttcactgccttcttcatcctcttacagttataggagaaagctcacaaacccagccaataaagaagagtctattcccttccacttccagatggaaaaacaagtaattcatgctgaaatccaacccctgggtcattggatggatgcgacatttaatattaagactgcatttcattgttatggtgcatgccagaaatactcttatccatggcagacatctaagtgcttctttgaaaaggactaccagtatgaaacaggctggggctgtaatcctggtgactgcccaggggttgggactggatgcactgcttgtggtgtttatctcgataaactaaaatctgttgggaaggcctataagataatttctttaaaatataccagaaaggtttgtattcagttaggaacagaacaaacttgcaagcatattgatgcaaatgattgtttagtgacaccatctgtgaaagtttgcatagtgggcacagtttcaaaacttcaaccatctgatactcttttgttcttaggtccactagaacaagggggaatcattcttaagcaatggtgcacaacatcatgtgcatttggggaccctggtgatatcatgtccactcccagtggtatgaggtgtccagagcacactggatcatttaggaaaatttgcggttttgctactacaccagtttgtgaatatcaaggaaataccatttctggatataaaagaatgatggcaacaaaagattcattccaatcatttaacttaacagaacctcacatcacaacaaacaagctggaatggatcgacccagatgggaatacaagagaccacgtaaaccttgtcttaaatagagatgtctcatttcaggatttaagtgataacccctgtaaagtagacctacacacacaagcaatagaaggggcatggggttctggtgtagggtttacactcacatgtactgtcggattaacagagtgcccaagttttatgacatcaattaaggcatgtgacctagctatgtgttatggatcaacagtaacaaaccttgccaggggctctaatacagtgaaagtagttggtaaaggaggccattcagggtcctcatttaaatgctgtcatgatacagattgctcctctgaaggtttacttgcatcagcccctcatcttgagagggtaacaggattcaatcaaattgattcagataaggtttatgatgatggtgcaccaccttgcacattcaaatgctggttcactaagtcaggtgagtggcttcttgggatcttaaacgggaattggattgttgttgtagtgcttgttgtgatactcattctctctatcataatgttcagtgttttgtgtcccaggagagggcacaagaaaactgtctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16630 - RNA, 1669 nt, synthetic construct
  misc_feature 1..1669: note = mRNA product Design2 comprising derived and/or modified sequence from ANDV(Chile-9717869)__AF291702.1__N (opt4)
  source 1..1669: mol_type = other RNA
ggggcgctgcctacggaggtggcagccatctccttctcggcatcaagcttaccatgagcaccctgcaggagctgcaggagaacatcaccgcccacgagcagcagctggtgaccgccagacagaagctgaaggacgccgagaaggccgtggaggtggaccccgacgacgtgaacaagagcaccctgcagagcagaagagccgccgtgagcaccctggagaccaagctgggcgagctgaagagacagctggccgacctggtggccgcccagaagctggccaccaagcccgtggaccccaccggcctggagcccgacgaccacctgaaggagaagagcagcctgagatacggcaacgtgctggacgtgaacagcatcgacctggaggagcccagcggccagaccgccgactggaaggccatcggcgcctacatcctgggcttcgccatccccatcatcctgaaggccctgtacatgctgagcaccagaggcagacagaccgtgaaggacaacaagggcaccagaatcagattcaaggacgacagcagcttcgaggaggtgaacggcatcagaaagcccaagcacctgtacgtgagcatgcccaccgcccagagcaccatgaaggccgaggagatcacccccggcagattcagaaccatcgcctgcggcctgttccccgcccaggtgaaggccagaaacatcatcagccccgtgatgggcgtgatcggcttcggcttcttcgtgaaggactggatggacagaatcgaggagttcctggccgccgagtgccccttcctgcccaagcccaaggtggccagcgaggccttcatgagcaccaacaagatgtacttcctgaacagacagagacaggtgaacgagagcaaggtgcaggacatcatcgacctgatcgaccacgccgagaccgagagcgccaccctgttcaccgagatcgccaccccccacagcgtgtgggtgttcgcctgcgcccccgacagatgcccccccaccgccctgtacgtggccggcgtgcccgagctgggcgccttcttcagcatcctgcaggacatgagaaacaccatcatggccagcaagagcgtgggcaccgccgaggagaagctgaagaagaagagcgccttctaccagagctacctgagaagaacccagagcatgggcatccagctggaccagaagatcatcatcctgtacatgctgagctggggcaaggaggccgtgaaccacttccacctgggcgacgacatggaccccgagctgagacagctggcccagagcctgatcgacaccaaggtgaaggagatcagcaaccaggagcccctgaagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16631 - RNA, 3799 nt, synthetic construct
  misc_feature 1..3799: note = mRNA product Design2 comprising derived and/or modified sequence from ANDV(Chile-9717869)__AF291703.2__GP (opt4)
  source 1..3799: mol_type = other RNA
ggggcgctgcctacggaggtggcagccatctccttctcggcatcaagcttaccatggagggctggtacctggtggtgctgggcgtgtgctacaccctgaccctggccatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgagaaacgccgaccccgagttcgtgttcagccccggcatcgtgcccgagagcaaccacagcacctgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaagatcgagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16632 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (opt4)
  source 1..3799: mol_type = other RNA
ggggcgctgcctacggaggtggcagccatctccttctcggcatcaagcttaccatggactggacctggatcctgttcctggtggccgccgccaccagagtgcacagcatgcccaagaccatctacgagctgaagatggagtgcccccacaccgtgggcctgggccagggctacatcatcggcagcaccgagctgggcctgatcagcatcgaggccgccagcgacatcaagctggagagcagctgcaacttcgacctgcacaccaccagcatggcccagaagagcttcacccaggtggagtggagaaagaagagcgacaccaccgacaccaccaacgccgccagcaccaccttcgaggcccagaccaagaccgtgaacctgagaggcacctgcatcctggcccccgagctgtacgacaccctgaagaaggtgaagaagaccgtgctgtgctacgacctgacctgcaaccagacccactgccagcccaccgtgtacctgatcgcccccgtgctgacctgcatgagcatcagaagctgcatggccagcgtgttcaccagcagaatccaggtgatctacgagaagacccactgcgtgaccggccagctgatcgagggccagtgcttcaaccccgcccacaccctgaccctgagccagcccgcccacacctacgacaccgtgaccctgcccatcagctgcttcttcacccccaagaagagcgagcagctgaaggtgatcaagaccttcgagggcatcctgaccaagaccggctgcaccgagaacgccctgcagggctactacgtgtgcttcctgggcagccacagcgagcccctgatcgtgcccagcctggaggacatcagaagcgccgaggtggtgagcagaatgctggtgcaccccagaggcgaggaccacgacgccatccagaacagccagagccacctgagaatcgtgggccccatcaccgccaaggtgcccagcaccagcagcaccgacaccctgaagggcaccgccttcgccggcgtgcccatgtacagcagcctgagcaccctggtgagaaacgccgaccccgagttcgtgttcagccccggcatcgtgcccgagagcaaccacagcacctgcgacaagaagaccgtgcccatcacctggaccggctacctgcccatcagcggcgagatggagaaggtgaccggctgcaccgtgttctgcaccctggccggccccggcgccagctgcgaggcctacagcgagaacggcatcttcaacatcagcagccccacctgcctggtgaacaaggtgcagagattcagaggcagcgagcagaagatcaacttcatctgccagagagtggaccaggacgtggtggtgtactgcaacggccagaagaaggtgatcctgaccaagaccctggtgatcggccagtgcatctacaccttcaccagcctgttcagcctgatgcccgacgtggcccacagcctggccgtggagctgtgcgtgcccggcctgcacggctgggccaccgtgatgctgctgagcaccttctgcttcggctgggtgctgatccccgccgtgaccctgatcatcctgaagtgcctgagagtgctgaccttcagctgcagccactacaccaacgagagcaagttcaagttcatcctggagaaggtgaagatcgagtaccagaagaccatgggcagcatggtgtgcgacgtgtgccaccacgagtgcgagaccgccaaggagctggagagccacagacagagctgcatcaacggccagtgcccctactgcatgaccatcaccgaggccaccgagagcgccctgcaggcccactacagcatctgcaagctgaccggcagattccaggaggccctgaagaagagcctgaagaagcccgaggtgaagaagggctgctacagaaccctgggcgtgttcagatacaagagcagatgctacgtgggcctggtgtggtgcctgctgctgacctgcgagatcgtgatctgggccgccagcgccgagacccccctgatggagagcggctggagcgacaccgcccacggcgtgggcgagatccccatgaagaccgacctggagctggacttcagcctgcccagcagcagcagctacagctacagaagaaagctgaccaaccccgccaacaaggaggagagcatccccttccacttccagatggagaagcaggtgatccacgccgagatccagcccctgggccactggatggacgccaccttcaacatcaagaccgccttccactgctacggcgcctgccagaagtacagctacccctggcagaccagcaagtgcttcttcgagaaggactaccagtacgagaccggctggggctgcaaccccggcgactgccccggcgtgggcaccggctgcaccgcctgcggcgtgtacctggacaagctgaagagcgtgggcaaggcctacaagatcatcagcctgaagtacaccagaaaggtgtgcatccagctgggcaccgagcagacctgcaagcacatcgacgccaacgactgcctggtgacccccagcgtgaaggtgtgcatcgtgggcaccgtgagcaagctgcagcccagcgacaccctgctgttcctgggccccctggagcagggcggcatcatcctgaagcagtggtgcaccaccagctgcgccttcggcgaccccggcgacatcatgagcacccccagcggcatgagatgccccgagcacaccggcagcttcagaaagatctgcggcttcgccaccacccccgtgtgcgagtaccagggcaacaccatcagcggctacaagagaatgatggccaccaaggacagcttccagagcttcaacctgaccgagccccacatcaccaccaacaagctggagtggatcgaccccgacggcaacaccagagaccacgtgaacctggtgctgaacagagacgtgagcttccaggacctgagcgacaacccctgcaaggtggacctgcacacccaggccatcgagggcgcctggggcagcggcgtgggcttcaccctgacctgcaccgtgggcctgaccgagtgccccagcttcatgaccagcatcaaggcctgcgacctggccatgtgctacggcagcaccgtgaccaacctggccagaggcagcaacaccgtgaaggtggtgggcaagggcggccacagcggcagcagcttcaagtgctgccacgacaccgactgcagcagcgagggcctgctggccagcgccccccacctggagagagtgaccggcttcaaccagatcgacagcgacaaggtgtacgacgacggcgcccccccctgcaccttcaagtgctggttcaccaagagcggcgagtggctgctgggcatcctgaacggcaactggatcgtggtggtggtgctggtggtgatcctgatcctgagcatcatcatgttcagcgtgctgtgccccagaagaggccacaagaagaccgtgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16633 - RNA, 1669 nt, synthetic construct
  misc_feature 1..1669: note = mRNA product Design2 comprising derived and/or modified sequence from ANDV(Chile-9717869)__AF291702.1__N (opt3)
  source 1..1669: mol_type = other RNA
ggggcgctgcctacggaggtggcagccatctccttctcggcatcaagcttaccatgagcaccctgcaggagctccaagaaaacatcacagcccacgagcagcagcttgtgactgctagacagaagctgaaagacgcagaaaaggccgtcgaggttgatcccgacgatgtgaataaatccacgttgcaatctaggcgggcggctgtatcaaccttagaaacaaagctgggcgagctaaaacgccagctcgccgacctggtggcagcccagaaacttgctactaagcctgtcgatccaaccgggctggagccggacgatcatttgaaagaaaagagtagcctccgatacggaaacgtgctggacgttaattccattgatctggaggaaccctctggtcagacagcagactggaaagccataggcgcttatatcctcgggttcgccattcctatcattttaaaggcgctgtacatgctttcgacccgtggaagacaaactgtgaaagataacaagggcacaaggatccggtttaaggacgatagctcattcgaggaggtcaatggtatacgcaaaccaaagcacttgtatgtgagtatgcccaccgcacagtccacgatgaaagccgaagagatcactcctgggagatttaggaccattgcttgcggactgttcccagcccaggtaaaggcacggaacatcatttctcccgttatgggcgtgatcggctttgggttctttgtcaaagactggatggaccgcatagaagagttcctagctgccgaatgtccttttctcccaaagccgaaagtggcgagcgaggccttcatgtccacaaataagatgtactttctgaaccgacagagacaagtgaatgagtcaaaggtccaggatattatcgaccttattgatcatgcagaaactgagagtgctaccctgttcacagaaatcgccacgccccacagcgtttgggtgtttgcttgcgcccctgacaggtgtccacccaccgcattgtatgtagccggagtgcctgagctcggtgctttcttctctatcctgcaggatatgcggaacactattatggcgtccaaatcagtcggcacagcagaagagaagttaaagaagaaaagcgccttttaccaaagttatctgcgtcgcacccagtctatggggatacagctcgaccagaagatcattatcctttacatgctgtcctggggaaaggaggctgtgaatcatttccacttgggcgatgacatggatccagaactaagacaactggcccagagcctcatagacactaaagttaaggagatttcgaaccaggaacccctgaaactttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16634 - RNA, 3799 nt, synthetic construct
  misc_feature 1..3799: note = mRNA product Design2 comprising derived and/or modified sequence from ANDV(Chile-9717869)__AF291703.2__GP (opt3)
  source 1..3799: mol_type = other RNA
ggggcgctgcctacggaggtggcagccatctccttctcggcatcaagcttaccatggagggctggtacctggtggtcctcggggtttgctatacccttacactggccatgcccaagactatctacgaattgaaaatggagtgtcctcacacggtgggattaggtcagggctatattatagggagcaccgaactgggactaatctccattgaggctgcatctgacatcaagctcgaatcaagttgcaacttcgatctgcatacaactagcatggcccaaaaatcctttacccaggtagagtggagaaagaaatctgacacaaccgatactacaaatgcggcttcgaccacgttcgaggcccagactaagaccgtgaaccttaggggcacatgtattctggcaccagaattgtacgacactctcaagaaagtcaagaaaaccgtgctgtgctatgatctgacatgtaatcagacccactgccaaccgacggtttacctcatcgcccccgtgttaacttgtatgtcaatacggagctgcatggctagtgtctttacatcccgcatccaggtgatttatgagaagacccattgtgtaactggtcagctgatcgaagggcagtgcttcaaccctgcacacacacttaccttgtctcaaccagcccatacgtacgacaccgttacactgcccattagctgtttcttcactcctaaaaagtccgagcagctaaaggtgatcaaaacctttgagggaatactcacaaagactggctgcaccgaaaatgctctgcagggctactatgtctgcttccttgggtcacacagtgagccactgattgtgcccagcttggaagatatccgatctgccgaggtggtctcccgtatgctcgttcaccctagaggagaagaccatgatgcgattcagaactcacaaagccacctgaggatcgtgggtccaatcacagcaaaagtaccgagtacctcttccactgacacgttaaagggcacagcctttgctggggtgcccatgtacagctcgctgtctaccctcgtccggaatgccgatcctgagttcgtgttttccccaggaattgttcccgagtcaaaccatagtacttgtgacaaaaagaccgtgcctataacatggaccggctatcttccaatcagcggtgaaatggagaaagtcactgggtgcacagtgttctgtacgctggcaggacccggcgcttcctgcgaagcctactctgagaatggcatttttaacatcagctcaccgacctgtttggtaaataaggttcagcgcttcagagggagtgaacagaagataaacttcatttgccaaagggtggatcaggacgtcgtggtctattgtaatggacagaaaaaggtgatcctaactaaaacactggttatcggtcagtgcatttacacctttacatccctcttcagcctgatgcctgacgtggcgcactctcttgccgtagagctgtgtgtccccggcttgcacgggtgggcaactgtgatgctcctgtcaaccttttgcttcggatgggttttaatcccagctgtgacgctgattatactaaagtgtctccgggtcctgacctttagttgcagccattatacaaacgagtccaaattcaagtttatccttgaaaaggtgaaaattgagtaccaaaagactatgggctctatggtatgcgatgtgtgtcaccatgaatgcgagaccgccaaagaattggagtcgcaccgccagagctgtatcaatggtcagtgcccttactgtatgacaatcactgaggctaccgaatccgccctgcaggcacattattcaatttgcaagctcacggggcgattccaagaggccctgaaaaagagtcttaagaaacccgaagttaagaaaggctgttacagaacactgggagtctttaggtataagtctcggtgctacgtgggcttggtgtggtgtctcctgttaacctgcgagatagtcatctgggctgcgagcgcagagactccactgatggaatccgggtggtcagacacagcccacggagttggtgagattcccatgaaaaccgatctagaactcgacttcagcctgccttcttccagtagctattcttaccgtcgcaagctcactaacccagctaacaaggaggaatccatcccgtttcacttccagatggagaaacaggtgattcatgccgagatccagcccttgggccactggatggatgcaacctttaatataaagacagccttccattgttatggggcttgccaaaaatactcatacccttggcagacgagtaagtgcttctttgaaaaagactatcagtacgagaccggatggggctgtaacccaggtgattgccccggggtgggcactggatgtacagcctgcggcgtatatctggacaagctcaaaagcgtcgggaaggcatacaagatcatttcgctgaaatataccagaaaggtgtgtatccagttaggaacagaacaaacttgcaaacacattgatgcgaatgactgtctggttaccccttccgtgaaggtctgcatcgtgggtacggtttctaaacttcagccaagcgatacattgctctttctgggccccctagagcaagggggaataattctgaagcagtggtgtaccacttcatgcgcttttggcgacccgggtgacatcatgagtaccccttccgggatgaggtgtccagaacacacaggctctttccggaagatttgcggatttgccactacccccgtgtgcgagtaccagggcaacacaatcagcgggtataaacgaatgatggcaacgaaggattccttccagtcatttaatctcaccgagcctcatataactacaaacaaactggaatggatcgaccccgatggaaatacccgcgaccacgtaaaccttgtcttgaatagagatgtgagcttccaggacctgagtgataacccatgtaaggtggacttacatactcaagccattgagggcgcttggggttctggggtcggatttacacttacctgcacggttggcctgactgaatgtccttccttcatgaccagcatcaaagcctgcgatcttgcaatgtgttacggttcgacagtgaccaatctggctaggggctcaaacactgtaaaggtggtcgggaagggaggccactctgggagttcctttaaatgctgtcatgacacagattgcagctctgagggattgctcgccagcgcgccccacctggaacgggtgaccggcttcaatcagattgactccgataaggtttacgacgacggtgccccaccgtgtacatttaaatgctggttcactaagtcaggggagtggctactgggaatcctcaacggcaattggatagtggtcgtggttctggtggtcattcttatcttgagtatcattatgttcagcgtactgtgtcctcgcagaggtcacaaaaagaccgtgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16635 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (opt3)
  source 1..3799: mol_type = other RNA
ggggcgctgcctacggaggtggcagccatctccttctcggcatcaagcttaccatggactggacctggatcctgttcctcgtggccgctgcaacaagagtccacagcatgcccaagactatctacgaattgaaaatggagtgtcctcacacggtgggattaggtcagggctatattatagggagcaccgaactgggactaatctccattgaggctgcatctgacatcaagctcgaatcaagttgcaacttcgatctgcatacaactagcatggcccaaaaatcctttacccaggtagagtggagaaagaaatctgacacaaccgatactacaaatgcggcttcgaccacgttcgaggcccagactaagaccgtgaaccttaggggcacatgtattctggcaccagaattgtacgacactctcaagaaagtcaagaaaaccgtgctgtgctatgatctgacatgtaatcagacccactgccaaccgacggtttacctcatcgcccccgtgttaacttgtatgtcaatacggagctgcatggctagtgtctttacatcccgcatccaggtgatttatgagaagacccattgtgtaactggtcagctgatcgaagggcagtgcttcaaccctgcacacacacttaccttgtctcaaccagcccatacgtacgacaccgttacactgcccattagctgtttcttcactcctaaaaagtccgagcagctaaaggtgatcaaaacctttgagggaatactcacaaagactggctgcaccgaaaatgctctgcagggctactatgtctgcttccttgggtcacacagtgagccactgattgtgcccagcttggaagatatccgatctgccgaggtggtctcccgtatgctcgttcaccctagaggagaagaccatgatgcgattcagaactcacaaagccacctgaggatcgtgggtccaatcacagcaaaagtaccgagtacctcttccactgacacgttaaagggcacagcctttgctggggtgcccatgtacagctcgctgtctaccctcgtccggaatgccgatcctgagttcgtgttttccccaggaattgttcccgagtcaaaccatagtacttgtgacaaaaagaccgtgcctataacatggaccggctatcttccaatcagcggtgaaatggagaaagtcactgggtgcacagtgttctgtacgctggcaggacccggcgcttcctgcgaagcctactctgagaatggcatttttaacatcagctcaccgacctgtttggtaaataaggttcagcgcttcagagggagtgaacagaagataaacttcatttgccaaagggtggatcaggacgtcgtggtctattgtaatggacagaaaaaggtgatcctaactaaaacactggttatcggtcagtgcatttacacctttacatccctcttcagcctgatgcctgacgtggcgcactctcttgccgtagagctgtgtgtccccggcttgcacgggtgggcaactgtgatgctcctgtcaaccttttgcttcggatgggttttaatcccagctgtgacgctgattatactaaagtgtctccgggtcctgacctttagttgcagccattatacaaacgagtccaaattcaagtttatccttgaaaaggtgaaaattgagtaccaaaagactatgggctctatggtatgcgatgtgtgtcaccatgaatgcgagaccgccaaagaattggagtcgcaccgccagagctgtatcaatggtcagtgcccttactgtatgacaatcactgaggctaccgaatccgccctgcaggcacattattcaatttgcaagctcacggggcgattccaagaggccctgaaaaagagtcttaagaaacccgaagttaagaaaggctgttacagaacactgggagtctttaggtataagtctcggtgctacgtgggcttggtgtggtgtctcctgttaacctgcgagatagtcatctgggctgcgagcgcagagactccactgatggaatccgggtggtcagacacagcccacggagttggtgagattcccatgaaaaccgatctagaactcgacttcagcctgccttcttccagtagctattcttaccgtcgcaagctcactaacccagctaacaaggaggaatccatcccgtttcacttccagatggagaaacaggtgattcatgccgagatccagcccttgggccactggatggatgcaacctttaatataaagacagccttccattgttatggggcttgccaaaaatactcatacccttggcagacgagtaagtgcttctttgaaaaagactatcagtacgagaccggatggggctgtaacccaggtgattgccccggggtgggcactggatgtacagcctgcggcgtatatctggacaagctcaaaagcgtcgggaaggcatacaagatcatttcgctgaaatataccagaaaggtgtgtatccagttaggaacagaacaaacttgcaaacacattgatgcgaatgactgtctggttaccccttccgtgaaggtctgcatcgtgggtacggtttctaaacttcagccaagcgatacattgctctttctgggccccctagagcaagggggaataattctgaagcagtggtgtaccacttcatgcgcttttggcgacccgggtgacatcatgagtaccccttccgggatgaggtgtccagaacacacaggctctttccggaagatttgcggatttgccactacccccgtgtgcgagtaccagggcaacacaatcagcgggtataaacgaatgatggcaacgaaggattccttccagtcatttaatctcaccgagcctcatataactacaaacaaactggaatggatcgaccccgatggaaatacccgcgaccacgtaaaccttgtcttgaatagagatgtgagcttccaggacctgagtgataacccatgtaaggtggacttacatactcaagccattgagggcgcttggggttctggggtcggatttacacttacctgcacggttggcctgactgaatgtccttccttcatgaccagcatcaaagcctgcgatcttgcaatgtgttacggttcgacagtgaccaatctggctaggggctcaaacactgtaaaggtggtcgggaagggaggccactctgggagttcctttaaatgctgtcatgacacagattgcagctctgagggattgctcgccagcgcgccccacctggaacgggtgaccggcttcaatcagattgactccgataaggtttacgacgacggtgccccaccgtgtacatttaaatgctggttcactaagtcaggggagtggctactgggaatcctcaacggcaattggatagtggtcgtggttctggtggtcattcttatcttgagtatcattatgttcagcgtactgtgtcctcgcagaggtcacaaaaagaccgtgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16636 - RNA, 1669 nt, synthetic construct
  misc_feature 1..1669: note = mRNA product Design2 comprising derived and/or modified sequence from ANDV(Chile-9717869)__AF291702.1__N (opt1)
  source 1..1669: mol_type = other RNA
ggggcgctgcctacggaggtggcagccatctccttctcggcatcaagcttaccatgagcaccctgcaggagctccaggagaacatcaccgcccacgagcagcagctggtgacggcccgccagaagctgaaggacgcggagaaggccgtcgaggtggaccccgacgacgtgaacaagtccaccctccagagccggcgcgccgccgtctccaccctggagaccaagctgggcgagctcaagcggcagctggccgacctggtggcggcccagaagctcgccacgaagccggtggaccccaccgggctggagcccgacgaccacctgaaggagaagtccagcctccgctacggcaacgtcctggacgtgaacagcatcgacctggaggagccctccgggcagaccgccgactggaaggcgatcggcgcctacatcctcgggttcgccatcccgatcatcctgaaggccctgtacatgctcagcacccggggccgccagacggtgaaggacaacaagggcacccggatccgcttcaaggacgactccagcttcgaggaggtcaacgggatccggaagcccaagcacctgtacgtgtccatgcccaccgcccagagcaccatgaaggcggaggagatcacgcccggccgcttccggaccatcgcctgcgggctgttcccggcccaggtgaaggcccgcaacatcatctcccccgtcatgggcgtgatcgggttcggcttcttcgtgaaggactggatggaccggatcgaggagttcctcgccgcggagtgccccttcctgcccaagccgaaggtcgccagcgaggccttcatgtccaccaacaagatgtacttcctgaaccgccagcgccaggtgaacgagagcaaggtgcaggacatcatcgacctcatcgaccacgccgagaccgagtccgccacgctgttcaccgagatcgcgacgccccacagcgtctgggtgttcgcctgcgcccccgaccggtgcccgcccaccgccctgtacgtggccggcgtccccgagctcggggcgttcttctccatcctgcaggacatgcggaacaccatcatggccagcaagagcgtgggcaccgccgaggagaagctgaagaagaagtccgccttctaccagagctacctccgccggacccagtccatggggatccagctggaccagaagatcatcatcctgtacatgctcagctggggcaaggaggcggtgaaccacttccacctgggcgacgacatggaccccgagctgcgccagctcgcccagtccctgatcgacaccaaggtcaaggagatcagcaaccaggagcccctgaagctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16637 - RNA, 3799 nt, synthetic construct
  misc_feature 1..3799: note = mRNA product Design2 comprising derived and/or modified sequence from ANDV(Chile-9717869)__AF291703.2__GP (opt1)
  source 1..3799: mol_type = other RNA
ggggcgctgcctacggaggtggcagccatctccttctcggcatcaagcttaccatggagggctggtacctggtggtcctcggggtgtgctacaccctgaccctggccatgcccaagacgatctacgagctcaagatggagtgcccgcacaccgtgggcctggggcagggctacatcatcgggagcaccgagctgggcctcatctccatcgaggccgccagcgacatcaagctggagtccagctgcaacttcgacctgcacaccacgtccatggcccagaagtccttcacccaggtcgagtggcgcaagaagtccgacaccaccgacacgaccaacgccgccagcaccaccttcgaggcccagacgaagaccgtgaacctccgggggacctgcatcctggcgcccgagctgtacgacaccctcaagaaggtgaagaagacggtcctgtgctacgacctgacctgcaaccagacccactgccagcccaccgtgtacctcatcgcccccgtgctgacgtgcatgagcatccgcagctgcatggcctccgtcttcaccagccggatccaggtgatctacgagaagacccactgcgtgaccgggcagctgatcgagggccagtgcttcaacccggcccacacgctcaccctgtcccagcccgcgcacacctacgacaccgtcacgctgcccatcagctgcttcttcacccccaagaagtccgagcagctcaaggtgatcaagaccttcgaggggatcctgaccaagacgggctgcaccgagaacgccctgcaggggtactacgtgtgcttcctcggcagccactccgagccgctgatcgtccccagcctggaggacatccgctccgccgaggtggtgagccggatgctcgtccacccccgcggcgaggaccacgacgccatccagaacagccagtcccacctccggatcgtggggcccatcaccgccaaggtgccgagcacctccagcacggacaccctgaagggcaccgcgttcgccggggtccccatgtactccagcctgtccaccctggtgcgcaacgccgaccccgagttcgtgttcagccccggcatcgtcccggagtccaaccacagcacgtgcgacaagaagaccgtgcccatcacctggaccggctacctgcccatctccggggagatggagaaggtcaccggctgcacggtgttctgcaccctcgccgggcccggcgccagctgcgaggcgtactccgagaacgggatcttcaacatcagctccccgacctgcctggtgaacaaggtccagcggttccgcggcagcgagcagaagatcaacttcatctgccagcgggtggaccaggacgtggtcgtgtactgcaacggccagaagaaggtgatcctgaccaagacgctcgtcatcgggcagtgcatctacaccttcacctccctgttcagcctgatgcccgacgtggcccactccctcgccgtggagctgtgcgtccccggcctgcacgggtgggccaccgtgatgctcctgagcacgttctgcttcggctgggtgctgatccccgccgtcaccctcatcatcctgaagtgcctgcgcgtgctcaccttcagctgctcccactacaccaacgagagcaagttcaagttcatcctggagaaggtgaagatcgagtaccagaagacgatggggtccatggtctgcgacgtgtgccaccacgagtgcgagaccgcgaaggagctggagagccaccggcagtcctgcatcaacggccagtgcccgtactgcatgaccatcaccgaggccacggagagcgccctgcaggcccactactccatctgcaagctcaccggccgcttccaggaggccctgaagaagtccctgaagaagcccgaggtgaagaaggggtgctaccggaccctcggcgtcttccgctacaagagccggtgctacgtggggctggtgtggtgcctgctcctgacctgcgagatcgtcatctgggcggccagcgccgagacgcccctgatggagtccggctggagcgacaccgcccacggggtgggcgagatccccatgaagaccgacctcgagctggacttctccctgccgagctccagctcctacagctaccgccggaagctcaccaaccccgcgaacaaggaggagagcatccccttccacttccagatggagaagcaggtcatccacgccgagatccagccgctgggccactggatggacgccacgttcaacatcaagaccgccttccactgctacggggcctgccagaagtactcctacccctggcagaccagcaagtgcttcttcgagaaggactaccagtacgagaccggctgggggtgcaaccccggcgactgccccggcgtggggacgggctgcaccgcgtgcggggtgtacctggacaagctcaagtccgtgggcaaggcctacaagatcatcagcctgaagtacacccgcaaggtctgcatccagctggggaccgagcagacgtgcaagcacatcgacgccaacgactgcctcgtgaccccgtccgtgaaggtctgcatcgtgggcaccgtgagcaagctgcagccctccgacaccctcctgttcctgggccccctggagcagggcggcatcatcctcaagcagtggtgcaccacgagctgcgccttcggggaccccggcgacatcatgtccaccccgagcgggatgcggtgccccgagcacaccggctccttccgcaagatctgcggcttcgccaccacgcccgtctgcgagtaccaggggaacaccatcagcggctacaagcgcatgatggcgaccaaggactccttccagagcttcaacctgaccgagccccacatcacgaccaacaagctggagtggatcgacccggacgggaacacccgggaccacgtgaacctcgtgctgaaccgcgacgtctccttccaggacctgagcgacaacccctgcaaggtggacctccacacccaggccatcgagggcgcctgggggtccggcgtgggcttcacgctgacctgcaccgtcgggctgaccgagtgccccagcttcatgacgtccatcaaggcctgcgacctcgccatgtgctacggcagcaccgtgaccaacctggcgcgggggagcaacaccgtgaaggtcgtgggcaagggcgggcactccggcagctccttcaagtgctgccacgacacggactgcagctccgaggggctgctcgccagcgcgccccacctggagcgcgtgaccggcttcaaccagatcgactccgacaaggtctacgacgacggggccccgccctgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagacggtctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16638 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (opt1)
  source 1..3799: mol_type = other RNA
ggggcgctgcctacggaggtggcagccatctccttctcggcatcaagcttaccatggactggacctggatcctgttcctcgtggccgccgcgacccgcgtccacagcatgcccaagacgatctacgagctcaagatggagtgcccgcacaccgtgggcctggggcagggctacatcatcgggagcaccgagctgggcctcatctccatcgaggccgccagcgacatcaagctggagtccagctgcaacttcgacctgcacaccacgtccatggcccagaagtccttcacccaggtcgagtggcgcaagaagtccgacaccaccgacacgaccaacgccgccagcaccaccttcgaggcccagacgaagaccgtgaacctccgggggacctgcatcctggcgcccgagctgtacgacaccctcaagaaggtgaagaagacggtcctgtgctacgacctgacctgcaaccagacccactgccagcccaccgtgtacctcatcgcccccgtgctgacgtgcatgagcatccgcagctgcatggcctccgtcttcaccagccggatccaggtgatctacgagaagacccactgcgtgaccgggcagctgatcgagggccagtgcttcaacccggcccacacgctcaccctgtcccagcccgcgcacacctacgacaccgtcacgctgcccatcagctgcttcttcacccccaagaagtccgagcagctcaaggtgatcaagaccttcgaggggatcctgaccaagacgggctgcaccgagaacgccctgcaggggtactacgtgtgcttcctcggcagccactccgagccgctgatcgtccccagcctggaggacatccgctccgccgaggtggtgagccggatgctcgtccacccccgcggcgaggaccacgacgccatccagaacagccagtcccacctccggatcgtggggcccatcaccgccaaggtgccgagcacctccagcacggacaccctgaagggcaccgcgttcgccggggtccccatgtactccagcctgtccaccctggtgcgcaacgccgaccccgagttcgtgttcagccccggcatcgtcccggagtccaaccacagcacgtgcgacaagaagaccgtgcccatcacctggaccggctacctgcccatctccggggagatggagaaggtcaccggctgcacggtgttctgcaccctcgccgggcccggcgccagctgcgaggcgtactccgagaacgggatcttcaacatcagctccccgacctgcctggtgaacaaggtccagcggttccgcggcagcgagcagaagatcaacttcatctgccagcgggtggaccaggacgtggtcgtgtactgcaacggccagaagaaggtgatcctgaccaagacgctcgtcatcgggcagtgcatctacaccttcacctccctgttcagcctgatgcccgacgtggcccactccctcgccgtggagctgtgcgtccccggcctgcacgggtgggccaccgtgatgctcctgagcacgttctgcttcggctgggtgctgatccccgccgtcaccctcatcatcctgaagtgcctgcgcgtgctcaccttcagctgctcccactacaccaacgagagcaagttcaagttcatcctggagaaggtgaagatcgagtaccagaagacgatggggtccatggtctgcgacgtgtgccaccacgagtgcgagaccgcgaaggagctggagagccaccggcagtcctgcatcaacggccagtgcccgtactgcatgaccatcaccgaggccacggagagcgccctgcaggcccactactccatctgcaagctcaccggccgcttccaggaggccctgaagaagtccctgaagaagcccgaggtgaagaaggggtgctaccggaccctcggcgtcttccgctacaagagccggtgctacgtggggctggtgtggtgcctgctcctgacctgcgagatcgtcatctgggcggccagcgccgagacgcccctgatggagtccggctggagcgacaccgcccacggggtgggcgagatccccatgaagaccgacctcgagctggacttctccctgccgagctccagctcctacagctaccgccggaagctcaccaaccccgcgaacaaggaggagagcatccccttccacttccagatggagaagcaggtcatccacgccgagatccagccgctgggccactggatggacgccacgttcaacatcaagaccgccttccactgctacggggcctgccagaagtactcctacccctggcagaccagcaagtgcttcttcgagaaggactaccagtacgagaccggctgggggtgcaaccccggcgactgccccggcgtggggacgggctgcaccgcgtgcggggtgtacctggacaagctcaagtccgtgggcaaggcctacaagatcatcagcctgaagtacacccgcaaggtctgcatccagctggggaccgagcagacgtgcaagcacatcgacgccaacgactgcctcgtgaccccgtccgtgaaggtctgcatcgtgggcaccgtgagcaagctgcagccctccgacaccctcctgttcctgggccccctggagcagggcggcatcatcctcaagcagtggtgcaccacgagctgcgccttcggggaccccggcgacatcatgtccaccccgagcgggatgcggtgccccgagcacaccggctccttccgcaagatctgcggcttcgccaccacgcccgtctgcgagtaccaggggaacaccatcagcggctacaagcgcatgatggcgaccaaggactccttccagagcttcaacctgaccgagccccacatcacgaccaacaagctggagtggatcgacccggacgggaacacccgggaccacgtgaacctcgtgctgaaccgcgacgtctccttccaggacctgagcgacaacccctgcaaggtggacctccacacccaggccatcgagggcgcctgggggtccggcgtgggcttcacgctgacctgcaccgtcgggctgaccgagtgccccagcttcatgacgtccatcaaggcctgcgacctcgccatgtgctacggcagcaccgtgaccaacctggcgcgggggagcaacaccgtgaaggtcgtgggcaagggcgggcactccggcagctccttcaagtgctgccacgacacggactgcagctccgaggggctgctcgccagcgcgccccacctggagcgcgtgaccggcttcaaccagatcgactccgacaaggtctacgacgacggggccccgccctgcaccttcaagtgctggttcaccaagagcggcgagtggctgctcggcatcctgaacgggaactggatcgtggtggtcgtgctggtcgtgatcctcatcctgtccatcatcatgttcagcgtgctgtgcccccggcgcggccacaagaagacggtctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16639 - RNA, 1669 nt, synthetic construct
  misc_feature 1..1669: note = mRNA product Design2 comprising derived and/or modified sequence from ANDV(Chile-9717869)__AF291702.1__N (opt5)
  source 1..1669: mol_type = other RNA
ggggcgctgcctacggaggtggcagccatctccttctcggcatcaagcttaccatgagcaccctgcaggagctccaagaaaacatcacagcccacgagcagcagctggtgacggctagacagaaacttaaggacgccgaaaaggcggtcgaggttgatcccgacgatgtgaataaatccaccctgcaatctcggcgcgctgccgtgagcacactcgaaaccaagctgggcgagcttaaaagacagctggccgacctcgtcgctgcccagaagctggctacaaagcctgtggatccgaccgggctggagcccgacgatcatctcaaagaaaagtcctctctgcggtacggaaacgttcttgacgtgaatagcattgatctggaggaaccttccggccagacagccgactggaaagcgatcggggcctatattctcggattcgctatccccattatcctgaaggccctttacatgctgtctacccgcggcagacaaacggtcaaagataacaaggggacccggatccgctttaaggacgatagctccttcgaggaggtgaatggaattagaaaacctaagcacctctatgttagcatgcccacagctcagtctaccatgaaagccgaagagatcacacctggccggtttcgcaccattgcgtgcggcctgttcccggcccaggtgaaggctagaaacatcatttcccccgtcatgggggtgatcggatttggcttctttgtgaaagactggatggaccggattgaagagttcctggccgctgaatgtccttttctccccaagcctaaagtcgccagcgaggccttcatgtctacgaataagatgtactttctgaaccgccagagacaagttaatgagtccaaggtgcaggatatcatcgaccttattgatcatgctgaaacagagagcgcgaccctgttcacagaaatcgccacaccccactctgtgtgggtctttgcttgcgccccggaccggtgtcctcccaccgccctctatgtggctggggttcctgagctgggagccttcttctccattcttcaggatatgcgcaacaccatcatggcgagcaaatccgtgggcacggctgaagagaagctgaaaaagaaatctgccttttaccaaagctatctcagacggacccagtccatggggattcagctggaccagaagatcatcattctgtacatgctcagctggggaaaggaggccgtcaatcatttccacctgggcgatgacatggatcccgaacttagacaactggctcagtctctcatcgacacaaaagtgaaggagatttccaaccaggaacccctgaaactttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16640 - RNA, 3799 nt, synthetic construct
  misc_feature 1..3799: note = mRNA product Design2 comprising derived and/or modified sequence from ANDV(Chile-9717869)__AF291703.2__GP (opt5)
  source 1..3799: mol_type = other RNA
ggggcgctgcctacggaggtggcagccatctccttctcggcatcaagcttaccatggagggctggtacctggtggtcctcggggtttgctataccctgacacttgccatgcccaagacgatctacgaactgaaaatggagtgtcctcacaccgtgggactcggccaggggtatattatcggaagcacagaactgggccttatttccatcgaggctgcctctgacattaagctggaaagctcctgcaacttcgatctccataccacatctatggcgcaaaagagctttacccaggtggagtggagaaagaaatccgacacaaccgatacgaccaatgctgcctctacaaccttcgaggcccagacaaagaccgtcaacctgcgggggacgtgtatcctggctccggaactctacgacacactgaagaaagtgaagaaaaccgttctttgctatgatctgacatgtaatcagacccactgccaacccaccgtgtacctcatcgcccctgtcctgacatgtatgagcattcgctcctgcatggctagcgtgtttacgtctagaatccaggttatttatgagaagacccattgtgtgacaggacagcttatcgaaggccagtgcttcaaccccgcccacaccctgacactctcccaacctgcgcatacctacgacacggtcacactgcccattagctgctttttcacccctaaaaagtctgagcagctgaaggtgatcaaaacctttgagggcattctcacaaagaccgggtgcacagaaaatgccctgcagggatactatgtgtgcttccttggctcccacagcgagccgctgatcgtcccctctctcgaagatatccggtccgctgaggttgtgagccgcatgctggtgcaccctagaggggaagaccatgatgccattcagaactcccaatctcaccttcggatcgtcggacccattacggctaaagtgcctagcacctccagcacagacaccctgaagggcacagcctttgcgggggttcccatgtactcttccctcagcaccctggtgcgcaatgccgatccggagttcgtcttttctcctggaatcgtgcccgagagcaaccattccacgtgtgacaaaaagaccgttcctattacatggaccggctatctgcccatctctggcgaaatggagaaagtgacagggtgcaccgtcttctgtacgctcgctggacccggcgccagctgcgaagcctactccgagaatgggatctttaacattagctctcctacatgtctggtgaataaggtccagagattccggggatccgaacagaagatcaacttcatttgccaacgcgtggatcaggacgttgtggtctattgtaatggccagaaaaaggtgatccttaccaaaacactggttattgggcagtgcatctacacctttaccagcctcttctctctgatgccggacgtggcccactcccttgccgtcgagctgtgtgtgcccggactccacggctgggctacagtgatgctgctgagcacgttttgcttcggctgggttctcatccctgcggtcaccctgattatccttaagtgtctgagagtgctcacattttcctgctctcattataccaacgagagcaaattcaagtttattctggaaaaggtgaaaatcgagtaccaaaagacaatggggtccatggtctgcgatgtgtgtcaccatgaatgcgagaccgccaaagaactggagtctcaccggcagagctgtattaatggacagtgcccctactgtatgacgatcacagaggctaccgaatccgcccttcaggcccattatagcatttgcaagctcaccggccgcttccaagaggctctgaaaaagtctctgaagaaacctgaagttaagaaagggtgttacagaacactcggagtgtttcggtataagtcccgctgctacgtcggcctggtgtggtgtcttctgctcacctgtgagatcgttatctgggccgcgagcgctgagacacccctgatggaatctgggtggtccgacacggcccacggcgtgggagagattccgatgaaaaccgatctggaacttgacttcagcctcccttctagctccagctattcttacagacggaagctgacaaaccccgccaacaaggaggaatccatcccttttcacttccagatggagaaacaggtcattcatgctgagatccagcccctgggccactggatggatgccacctttaatattaagacagctttccattgttatggggcctgccaaaaatacagctacccttggcagacctccaagtgcttctttgaaaaagactatcagtacgagacgggatggggctgtaaccccggggattgcccgggagtgggcaccgggtgtacagcgtgcggcgtttatctcgacaagctgaaatctgtgggaaaggcctacaagatcatcagccttaaatataccagaaaggtctgtattcagctgggcacagaacaaacctgcaaacacatcgatgctaatgactgtctcgtgacaccttccgtgaaggtctgcattgttgggaccgtgtctaaactgcagcccagcgatacgctgcttttcctcggacccctggagcagggcgggatcattctgaagcaatggtgtacaacctcctgcgcctttggagaccctggcgacatcatgtctaccccgagcgggatgcgctgtcccgaacacacaggctccttccggaagatctgcggatttgctaccacgcctgtgtgcgagtaccagggcaacacaattagcgggtataaaagaatgatggccaccaaggattctttccagtcctttaatctcacagagccccatatcaccacaaacaaactggaatggattgaccctgatggaaatacccgcgaccacgtcaaccttgtgctgaatcgggatgttagcttccaggacctctctgataacccctgtaaggtggacctgcatacgcaagcgatcgagggcgcctgggggtccggagtcggctttaccctgacatgcaccgtggggcttacagaatgtcctagcttcatgacctctattaaggcttgcgatctcgccatgtgttacggctccacggttacaaatctggctagaggaagcaacaccgtgaaagtcgtgggcaaagggggacactccggcagctcttttaaatgctgtcatgacacagattgcagctccgaggggctgctcgcctctgctccccacctggaacgcgttaccggattcaatcagatcgacagcgataaggtgtacgacgacggcgctccgccttgtacctttaaatgctggttcacaaagtccggcgagtggcttctggggatcctcaacggaaattggattgtcgtggtggtcctggttgtgatcctgattctttctatcattatgttcagcgtgctgtgtccccggagaggccacaaaaagacggtctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16641 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (opt5)
  source 1..3799: mol_type = other RNA
ggggcgctgcctacggaggtggcagccatctccttctcggcatcaagcttaccatggactggacctggatcctgttcctcgtggccgctgccacaagagtccacagcatgcccaagacgatctacgaactgaaaatggagtgtcctcacaccgtgggactcggccaggggtatattatcggaagcacagaactgggccttatttccatcgaggctgcctctgacattaagctggaaagctcctgcaacttcgatctccataccacatctatggcgcaaaagagctttacccaggtggagtggagaaagaaatccgacacaaccgatacgaccaatgctgcctctacaaccttcgaggcccagacaaagaccgtcaacctgcgggggacgtgtatcctggctccggaactctacgacacactgaagaaagtgaagaaaaccgttctttgctatgatctgacatgtaatcagacccactgccaacccaccgtgtacctcatcgcccctgtcctgacatgtatgagcattcgctcctgcatggctagcgtgtttacgtctagaatccaggttatttatgagaagacccattgtgtgacaggacagcttatcgaaggccagtgcttcaaccccgcccacaccctgacactctcccaacctgcgcatacctacgacacggtcacactgcccattagctgctttttcacccctaaaaagtctgagcagctgaaggtgatcaaaacctttgagggcattctcacaaagaccgggtgcacagaaaatgccctgcagggatactatgtgtgcttccttggctcccacagcgagccgctgatcgtcccctctctcgaagatatccggtccgctgaggttgtgagccgcatgctggtgcaccctagaggggaagaccatgatgccattcagaactcccaatctcaccttcggatcgtcggacccattacggctaaagtgcctagcacctccagcacagacaccctgaagggcacagcctttgcgggggttcccatgtactcttccctcagcaccctggtgcgcaatgccgatccggagttcgtcttttctcctggaatcgtgcccgagagcaaccattccacgtgtgacaaaaagaccgttcctattacatggaccggctatctgcccatctctggcgaaatggagaaagtgacagggtgcaccgtcttctgtacgctcgctggacccggcgccagctgcgaagcctactccgagaatgggatctttaacattagctctcctacatgtctggtgaataaggtccagagattccggggatccgaacagaagatcaacttcatttgccaacgcgtggatcaggacgttgtggtctattgtaatggccagaaaaaggtgatccttaccaaaacactggttattgggcagtgcatctacacctttaccagcctcttctctctgatgccggacgtggcccactcccttgccgtcgagctgtgtgtgcccggactccacggctgggctacagtgatgctgctgagcacgttttgcttcggctgggttctcatccctgcggtcaccctgattatccttaagtgtctgagagtgctcacattttcctgctctcattataccaacgagagcaaattcaagtttattctggaaaaggtgaaaatcgagtaccaaaagacaatggggtccatggtctgcgatgtgtgtcaccatgaatgcgagaccgccaaagaactggagtctcaccggcagagctgtattaatggacagtgcccctactgtatgacgatcacagaggctaccgaatccgcccttcaggcccattatagcatttgcaagctcaccggccgcttccaagaggctctgaaaaagtctctgaagaaacctgaagttaagaaagggtgttacagaacactcggagtgtttcggtataagtcccgctgctacgtcggcctggtgtggtgtcttctgctcacctgtgagatcgttatctgggccgcgagcgctgagacacccctgatggaatctgggtggtccgacacggcccacggcgtgggagagattccgatgaaaaccgatctggaacttgacttcagcctcccttctagctccagctattcttacagacggaagctgacaaaccccgccaacaaggaggaatccatcccttttcacttccagatggagaaacaggtcattcatgctgagatccagcccctgggccactggatggatgccacctttaatattaagacagctttccattgttatggggcctgccaaaaatacagctacccttggcagacctccaagtgcttctttgaaaaagactatcagtacgagacgggatggggctgtaaccccggggattgcccgggagtgggcaccgggtgtacagcgtgcggcgtttatctcgacaagctgaaatctgtgggaaaggcctacaagatcatcagccttaaatataccagaaaggtctgtattcagctgggcacagaacaaacctgcaaacacatcgatgctaatgactgtctcgtgacaccttccgtgaaggtctgcattgttgggaccgtgtctaaactgcagcccagcgatacgctgcttttcctcggacccctggagcagggcgggatcattctgaagcaatggtgtacaacctcctgcgcctttggagaccctggcgacatcatgtctaccccgagcgggatgcgctgtcccgaacacacaggctccttccggaagatctgcggatttgctaccacgcctgtgtgcgagtaccagggcaacacaattagcgggtataaaagaatgatggccaccaaggattctttccagtcctttaatctcacagagccccatatcaccacaaacaaactggaatggattgaccctgatggaaatacccgcgaccacgtcaaccttgtgctgaatcgggatgttagcttccaggacctctctgataacccctgtaaggtggacctgcatacgcaagcgatcgagggcgcctgggggtccggagtcggctttaccctgacatgcaccgtggggcttacagaatgtcctagcttcatgacctctattaaggcttgcgatctcgccatgtgttacggctccacggttacaaatctggctagaggaagcaacaccgtgaaagtcgtgggcaaagggggacactccggcagctcttttaaatgctgtcatgacacagattgcagctccgaggggctgctcgcctctgctccccacctggaacgcgttaccggattcaatcagatcgacagcgataaggtgtacgacgacggcgctccgccttgtacctttaaatgctggttcacaaagtccggcgagtggcttctggggatcctcaacggaaattggattgtcgtggtggtcctggttgtgatcctgattctttctatcattatgttcagcgtgctgtgtccccggagaggccacaaaaagacggtctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16642 - RNA, 1669 nt, synthetic construct
  misc_feature 1..1669: note = mRNA product Design2 comprising derived and/or modified sequence from ANDV(Chile-9717869)__AF291702.1__N (opt11)
  source 1..1669: mol_type = other RNA
ggggcgctgcctacggaggtggcagccatctccttctcggcatcaagcttaccatgtccaccctccaagaactccaagaaaacatcacagcacacgagcaacaactcgtaactgcccgtcaaaaactcaaagacgcggaaaaagccgtcgaagtcgaccccgacgacgtcaataaatccaccctccaatcacgccgcgccgcagtcagcaccctcgaaaccaaactcggcgaactcaaacgacaactagccgacctcgtagcagcccaaaaactcgcaaccaaacccgtagaccccaccggactagaacccgacgaccacctcaaagaaaaatcctccctaagatacggcaacgtcctcgacgtcaacagcatcgacctagaggaaccaagcggccaaacagcagactggaaagccatcggcgcctacatcctaggattcgccatcccaatcatactcaaagccctctacatgctttccacacgcggacgccaaacggttaaagacaacaaaggcacacgaataagatttaaagacgacagctccttcgaagaagtcaacggcatccgcaaacccaaacacctctacgtatcaatgcccaccgcccaatccaccatgaaagccgaagaaatcacacccggccgattcagaacaatcgcctgcggactcttcccggcccaagtcaaagcccgaaacatcatatcccccgtcatgggagtcatcggcttcggcttcttcgtcaaagactggatggaccgcatcgaagagttcctcgccgccgaatgcccattcttaccaaaaccgaaagtcgcctccgaggctttcatgtctacgaacaaaatgtacttcctcaacagacaacgccaagtcaacgaatcaaaagtccaagacataatcgacttaatcgaccatgcagaaacagaatccgccaccctcttcaccgaaatagccacaccccacagcgtctgggtcttcgcctgcgcccccgaccgatgcccaccaaccgccctatatgtagccggcgtacccgaactcggcgccttcttctcaatcctccaagacatgaggaacaccatcatggcatccaaatcagtaggcaccgccgaagaaaagctaaagaagaaaagcgcattctaccaaagctacctacgacgcacccaatcaatgggaatccaactcgaccagaaaatcataatcctatacatgctctcctggggaaaagaagcagtaaaccacttccacctaggcgacgacatggaccccgaactccgccaactcgcccaatcactcatcgacactaaagtaaaagagatatccaaccaagaaccactcaaactataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16643 - RNA, 3799 nt, synthetic construct
  misc_feature 1..3799: note = mRNA product Design2 comprising derived and/or modified sequence from ANDV(Chile-9717869)__AF291703.2__GP (opt11)
  source 1..3799: mol_type = other RNA
ggggcgctgcctacggaggtggcagccatctccttctcggcatcaagcttaccatggaggggtggtacttagtcgtattgggagtctgctacacactgacacttgccatgccaaaaacaatttacgaactcaagatggaatgtccccacaccgtcggcctaggccaaggctacattatcggttctactgaactgggactaatttccatagaagcggcatctgacatcaaactcgagagcagctgcaacttcgaccttcacacaacttccatggcccagaaatctttcacgcaggtcgaatggcgcaagaaatcagacacaacggacaccacaaacgcggcctcaaccacctttgaagcccaaaccaaaaccgtaaacctacgaggaacctgtatcctcgcacccgagctttacgacaccctcaagaaagtcaaaaagaccgtactctgctacgacctaacctgcaatcagacacactgccaaccaaccgtatatctaatcgctcccgtattaacatgcatgtccatccgaagctgcatggcatcagtcttcaccagcagaatacaagtaatctatgaaaagacccactgtgtcacaggccaattaatcgaaggccagtgcttcaatccagcccacaccctcaccctatcacaacccgcccacacctacgatacagtcacacttcccatatcctgcttcttcacacccaagaaatccgagcaactcaaagtgatcaaaacctttgagggcattctgaccaaaaccggctgtaccgagaacgcgctccaaggctattacgtgtgttttctaggcagtcactccgaaccactgatcgtaccatccctcgaagacatccggtcggccgaagtagtctcccgcatgctcgttcacccacgaggcgaagaccacgacgctatccaaaactcacaatcccatctgcgcatcgtcggaccaataaccgcgaaggtcccgtcaacgtcgtccaccgacacactcaaaggcaccgcctttgccggcgtacccatgtactcctccctatccacgctcgtccgaaatgccgaccccgagttcgtattctcaccaggcatagtaccggaaagcaaccactccacgtgcgacaagaaaacggtccccatcacttggaccggctacctgccaatctcaggggaaatggaaaaagtcaccggttgcactgttttctgcactctagcaggcccaggcgcaagctgcgaagcctactcagaaaacggcatattcaacattagcagcccaacatgtctcgtaaacaaagtacaacgctttcgaggctccgaacagaaaataaacttcatatgccaaagggtcgaccaagacgtcgtagtctactgcaacggccaaaagaaagtaatcctcaccaaaacactcgtcatcggacagtgcatctacacatttacctcactattcagcctcatgccagatgtcgcgcactcccttgcagtggagctctgcgtaccagggctacacggctgggccaccgtaatgcttctatccacattttgcttcgggtgggtcctaattcccgccgtcaccctgatcatactaaaatgcctccgagtcctcactttctcgtgctcacactacacaaacgaatccaaattcaaattcatactcgaaaaagtaaaaatagaataccagaaaacgatgggatcaatggtatgcgacgtatgtcaccacgagtgtgagaccgccaaagaacttgaatcgcaccgccaatcctgcatcaacggacaatgcccatactgcatgaccataacagaagcaaccgaaagcgccctccaagcccactactcaatctgcaaactgaccggaaggttccaggaagcccttaagaaatccctaaagaaacccgaggtaaagaaaggctgctaccgcacgctcggagtcttccgatacaaatctcgctgttacgtaggcctagtctggtgcctactcctaacctgcgaaatagtcatctgggcggcctcggccgaaaccccgctcatggaatccggctggtccgacaccgcccacggagtcggagaaataccaatgaaaacagacctcgaactcgacttctctctaccctcctcctcaagctacagctaccgccgcaaacttaccaaccccgccaataaagaagaaagtatcccatttcacttccaaatggagaaacaagtaattcacgccgaaatccagcctctcggccactggatggacgcaaccttcaacatcaaaacagcgttccactgctacggcgcctgccaaaaatacagctacccctggcagacctccaaatgtttcttcgagaaagactaccaatacgaaacagggtggggctgtaaccccggcgactgcccaggagtcggtacaggctgtactgcctgtggcgtctacctcgacaaactaaaatctgtaggcaaagcatacaaaatcatcagcctgaaatacacacgcaaagtatgtatccaactaggaacagaacaaacgtgcaaacacattgatgccaacgactgccttgtgacaccctccgtcaaagtatgcatcgttggaaccgtatccaaactccaaccctccgacaccctcctatttcttggtcccctagaacaagggggcatcatccttaaacaatggtgcaccacctcctgcgcattcggagacccaggcgacataatgtcaaccccaagcggaatgcgatgtccagagcacacaggctcctttcgcaaaatatgcggcttcgcaaccacaccggtctgcgaataccaaggcaacacaatctccggctacaaaagaatgatggccacgaaagactccttccaatcgttcaacctcaccgaaccccatatcacaaccaacaaactcgagtggattgaccccgacggcaacacccgcgaccacgtcaacctcgtcctcaaccgtgacgtatcgttccaagacctcagcgacaacccctgcaaagtcgacctacacacacaggcgatcgaaggcgcttggggtagcggcgtcggcttcacactaacctgcaccgttggactcaccgaatgcccttccttcatgacttccatcaaggcatgcgacctcgccatgtgctacggctccaccgtcacaaacctggccagaggatccaacaccgtaaaagttgtaggaaaaggcggccactcaggaagcagctttaaatgctgccacgacaccgattgctcctctgaaggcctacttgcctccgcgccacacctagaacgcgtaaccgggttcaaccagatagacagcgacaaggtgtacgacgacggcgcgcctccatgcactttcaaatgctggttcacaaaatcaggagaatggctcttaggcatactcaacggcaattggatagtagtcgtcgtcctagtagtaatactgatcttatctatcatcatgttctcagttctttgccccagacgggggcacaagaagacagtctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16644 - RNA, 3799 nt, synthetic construct
  misc_feature 1..3799: note = mRNA product Design2 comprising derived and/or modified sequence from ANDV(Chile-9717869)__AF291703.2__IgE-leader_Gn-Gc (opt11)
  source 1..3799: mol_type = other RNA
ggggcgctgcctacggaggtggcagccatctccttctcggcatcaagcttaccatggattggacgtggatactctttctcgtggccgcggccacgcgcgtgcactcgatgccaaaaacaatttacgaactcaagatggaatgtccccacaccgtcggcctaggccaaggctacattatcggttctactgaactgggactaatttccatagaagcggcatctgacatcaaactcgagagcagctgcaacttcgaccttcacacaacttccatggcccagaaatctttcacgcaggtcgaatggcgcaagaaatcagacacaacggacaccacaaacgcggcctcaaccacctttgaagcccaaaccaaaaccgtaaacctacgaggaacctgtatcctcgcacccgagctttacgacaccctcaagaaagtcaaaaagaccgtactctgctacgacctaacctgcaatcagacacactgccaaccaaccgtatatctaatcgctcccgtattaacatgcatgtccatccgaagctgcatggcatcagtcttcaccagcagaatacaagtaatctatgaaaagacccactgtgtcacaggccaattaatcgaaggccagtgcttcaatccagcccacaccctcaccctatcacaacccgcccacacctacgatacagtcacacttcccatatcctgcttcttcacacccaagaaatccgagcaactcaaagtgatcaaaacctttgagggcattctgaccaaaaccggctgtaccgagaacgcgctccaaggctattacgtgtgttttctaggcagtcactccgaaccactgatcgtaccatccctcgaagacatccggtcggccgaagtagtctcccgcatgctcgttcacccacgaggcgaagaccacgacgctatccaaaactcacaatcccatctgcgcatcgtcggaccaataaccgcgaaggtcccgtcaacgtcgtccaccgacacactcaaaggcaccgcctttgccggcgtacccatgtactcctccctatccacgctcgtccgaaatgccgaccccgagttcgtattctcaccaggcatagtaccggaaagcaaccactccacgtgcgacaagaaaacggtccccatcacttggaccggctacctgccaatctcaggggaaatggaaaaagtcaccggttgcactgttttctgcactctagcaggcccaggcgcaagctgcgaagcctactcagaaaacggcatattcaacattagcagcccaacatgtctcgtaaacaaagtacaacgctttcgaggctccgaacagaaaataaacttcatatgccaaagggtcgaccaagacgtcgtagtctactgcaacggccaaaagaaagtaatcctcaccaaaacactcgtcatcggacagtgcatctacacatttacctcactattcagcctcatgccagatgtcgcgcactcccttgcagtggagctctgcgtaccagggctacacggctgggccaccgtaatgcttctatccacattttgcttcgggtgggtcctaattcccgccgtcaccctgatcatactaaaatgcctccgagtcctcactttctcgtgctcacactacacaaacgaatccaaattcaaattcatactcgaaaaagtaaaaatagaataccagaaaacgatgggatcaatggtatgcgacgtatgtcaccacgagtgtgagaccgccaaagaacttgaatcgcaccgccaatcctgcatcaacggacaatgcccatactgcatgaccataacagaagcaaccgaaagcgccctccaagcccactactcaatctgcaaactgaccggaaggttccaggaagcccttaagaaatccctaaagaaacccgaggtaaagaaaggctgctaccgcacgctcggagtcttccgatacaaatctcgctgttacgtaggcctagtctggtgcctactcctaacctgcgaaatagtcatctgggcggcctcggccgaaaccccgctcatggaatccggctggtccgacaccgcccacggagtcggagaaataccaatgaaaacagacctcgaactcgacttctctctaccctcctcctcaagctacagctaccgccgcaaacttaccaaccccgccaataaagaagaaagtatcccatttcacttccaaatggagaaacaagtaattcacgccgaaatccagcctctcggccactggatggacgcaaccttcaacatcaaaacagcgttccactgctacggcgcctgccaaaaatacagctacccctggcagacctccaaatgtttcttcgagaaagactaccaatacgaaacagggtggggctgtaaccccggcgactgcccaggagtcggtacaggctgtactgcctgtggcgtctacctcgacaaactaaaatctgtaggcaaagcatacaaaatcatcagcctgaaatacacacgcaaagtatgtatccaactaggaacagaacaaacgtgcaaacacattgatgccaacgactgccttgtgacaccctccgtcaaagtatgcatcgttggaaccgtatccaaactccaaccctccgacaccctcctatttcttggtcccctagaacaagggggcatcatccttaaacaatggtgcaccacctcctgcgcattcggagacccaggcgacataatgtcaaccccaagcggaatgcgatgtccagagcacacaggctcctttcgcaaaatatgcggcttcgcaaccacaccggtctgcgaataccaaggcaacacaatctccggctacaaaagaatgatggccacgaaagactccttccaatcgttcaacctcaccgaaccccatatcacaaccaacaaactcgagtggattgaccccgacggcaacacccgcgaccacgtcaacctcgtcctcaaccgtgacgtatcgttccaagacctcagcgacaacccctgcaaagtcgacctacacacacaggcgatcgaaggcgcttggggtagcggcgtcggcttcacactaacctgcaccgttggactcaccgaatgcccttccttcatgacttccatcaaggcatgcgacctcgccatgtgctacggctccaccgtcacaaacctggccagaggatccaacaccgtaaaagttgtaggaaaaggcggccactcaggaagcagctttaaatgctgccacgacaccgattgctcctctgaaggcctacttgcctccgcgccacacctagaacgcgtaaccgggttcaaccagatagacagcgacaaggtgtacgacgacggcgcgcctccatgcactttcaaatgctggttcacaaaatcaggagaatggctcttaggcatactcaacggcaattggatagtagtcgtcgtcctagtagtaatactgatcttatctatcatcatgttctcagttctttgccccagacgggggcacaagaagacagtctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16645 - protein, 429 aa, synthetic construct; identical to SEQ ID NO: 249
  REGION 1..429: note = derived and/or modified protein sequence (wt) from DOBV(DOBV/Ano-Poroia/Afl9/1999)__NC_005233.1__N

SEQ ID NO: 16646 - protein, 1135 aa, synthetic construct; identical to SEQ ID NO: 933
  REGION 1..1135: note = derived and/or modified protein sequence (wt) from DOBV(DOBV/Ano-Poroia/Afl9/1999)__NC_005234.1__GP

SEQ ID NO: 16647 - protein, 1135 aa, synthetic construct
  REGION 1..1135: note = derived and/or modified protein sequence (wt) from DOBV(DOBV/Ano-Poroia/Afl9/1999)__NC_005234.1__IgE-leader_Gn -Gc
MDWTWILFLVAAATRVHSLRNVYDMKIECPHSINFGESSVTGKVELPPLLLTDAEALVPESSCNMDNHQSMSIIQKVTKVSWRKKADKAQAAKDSFETTSSEVNLKGTCALSHRMVEESYRNRRSVICYDLSCNSTHCKPTMHMIVPVHSCNMMKSCLVGLGPYRIQIVYERTYCTTGILTEGKCFVPDQSIVNVIKNGVFDIASVSIVCFFIRVKGTNYKIMASIKTATANNCNDTDNKVQGYYLCIVGGNSSPVYAPSTTDFRSMEALASLLRAPHGEDHDLSGEEVATYSIAGQIEGKIPHTANAANMLFTAFSGIPSYSSLSVFIGSQDGPVIYSPGLFPRLNQSSCDKIALPLIWEGYIDLPGYYETVHPCNVFCVLSGPGASCEAFSEGGIFNITSPTCLVSKQNRFRAAEQQVNFVCQRVDQDIVIYCNGQKKTILTKTLVIGQCIYSVTSLFSIMPGVAHSIAIELCVPGFHGWATAALLTTFCFGWILILSITLAVLVVLKFFAAILHNSSQENRFKIILRKIKEEFEKTKGSMVCEVCKYECETGKELKAHNLSCPQSQCPYCFTHCEPTESAFQAHYKVCQATHRFRDDLKKTITPQSTSPGCYRTLNLFRYKSRCYIFTVWVTLLIIESIMWAASASETVLEPSWNDNAHGVGVVPMHTDLELDFSLPSSSKYTYKRKLTSPLNQEQSVDLHIEIESQGISTSVHALGHWFDGRLNLKTSFHCYGACTKYEYPWHTAKCHFERDFEYENNWGCNPADCPGIGTGCTACGLYIDQLKPVGSAYKLITVRYSRKVCVQFGEENLCKTIDMNDCFVTRHVKVCIIGTVSKFSQGDTLVFLGPMEGGGLIFKDWCTSTCQFGDPGDIMSPKDKGFSCPDFTGHFRKKCNFATTPVCEYDGNMVSGYKKVMATIDSFQSFNTSSIHYTDERIEWKDPDGMLKDHLNILVTKDIDFENLGENPCKVGLQTSSIEGAWGSGVGFTLTCQISLTECSRFLTSIKACDMAICYGAQSVTLIRGQNTVKVSGKGGHSGSSFKCCHGTDCSQQGLQASAPHLDKVNGIVEQESEKVYDDGAPQCGISCWFVKSGEWITGIFNGNWIVIVVLVFFFILSLILLSLLCPIRKHKRS

SEQ ID NO: 16648 - RNA, 1290 nt, synthetic construct; identical to SEQ ID NO: 2584
  misc_feature 1..1290: note = derived and/or modified CDS sequence (wt) from DOBV(DOBV/Ano-Poroia/Afl9/1999)__NC_005233.1__N
  source 1..1290: mol_type = other RNA

SEQ ID NO: 16649 - RNA, 1290 nt, synthetic construct
  misc_feature 1..1290: note = derived and/or modified CDS sequence (wt) from DOBV(DOBV/Ano-Poroia/Afl9/1999)__NC_005233.1__N
  source 1..1290: mol_type = other RNA
atggcaacattagaggaactccaaaaagaaatcaacaaccacgagggccaattggtgatagccaggcagaaggtgaaagatgcagaaaagcagtatgaaaaggatcctgacgacctgaataaaagggcattgagtgaccgggaaagcattgcacaatcaattcagggaaaaatagatgaattaaggagacagctggctgatcgtgtggcagcagggaaaaacattggcaaagagagggacccaactggactagaccctggagatcacctcaaagagaagtcaatgctcagttatggaaatgtcattgacctcaaccatcttgacattgatgaacctacagggcaaaccgcagactggctgagcattgtggtctacctgacatcattcgtggttccaatattgttgaaggctctttacatgcttaccaccagagggagacaaactactaaagacaataagggaatgagaatccgatttaaggatgacagctcttttgaagatgtgaatgggattagaaagccaaagcacctgttcttgtcaatgcccaatgcacaatctagcatgaaggcagatgagattacaccaggtcggttcaggactgcaatttgtggactatacccagcccaggtgaaggcaaggaacttaatcagtcctgtgatgagtgtgattgggtttttagcccttgcaaagaactggacagagcgggttgaggaatggcttgacctcccgtgcaagctactatctgagccatctccaacgtctttgaccaaaggcccatccaccaatcgtgactacttgaatcaaagacaaggagcgcttgcaaaaatggaaacaaaagaagctcaggctgtgaggaaacatgccatagatgctggctgcaaccttatcgaccatatagactcaccatcatcaatctgggtctttgcaggagcacccgacagatgccctcctacctgcctgttcattgcaggcatggcagagctaggtgcattctttgctgttctccaggatatgaggaacaccatcatggcgtcaaaaactatcggaacatctgaggagaagctaaagaagaaatcatctttttaccaatcttacctacggaggacacaatctatggggatacaactggaccagcgcatcatcgtgctgttcatggttgactggggaaaagaggcagttgatagttttcatcttggtgatgatatggatcctgagctccggggcctggcacaggcattaattgatcaaaaagtgaaggaaatatctaatcaggaaccgcttaagctgtaa

SEQ ID NO: 16650 - RNA, 3408 nt, synthetic construct; identical to SEQ ID NO: 3268
  misc_feature 1..3408: note = derived and/or modified CDS sequence (wt) from DOBV(DOBV/Ano-Poroia/Afl9/1999)__NC_005234.1__GP
  source 1..3408: mol_type = other RNA

SEQ ID NO: 16651 - RNA, 3408 nt, synthetic construct
  misc_feature 1..3408: note = derived and/or modified CDS sequence (wt) from DOBV(DOBV/Ano-Poroia/Afl9/1999)__NC_005234.1__GP
  source 1..3408: mol_type = other RNA
atgatcatgtggggtttactattgacaatgattttgatcgattttggggcatccttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgacaagtttattttcaataatgcctggggtagcacattcaattgcaattgaattatgtgtaccagggttccatggttgggcaactgctgctctgctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacacaagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcctcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataa

SEQ ID NO: 16652 - RNA, 3408 nt, synthetic construct
  misc_feature 1..3408: note = derived and/or modified CDS sequence (wt) from DOBV(DOBV/Ano-Poroia/Afl9/1999)__NC_005234.1__IgE-leader_Gn -Gc
  source 1..3408: mol_type = other RNA
atggactggacctggatcctgttcctcgtggccgccgcgacccgcgtccacagcttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgactagtttattttcaataatgcctggggtagcacattcaattgcaattgaattatgtgtaccagggttccatggttgggcaactgctgctcttctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacactagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcttcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataa

SEQ ID NO: 16653 - RNA, 3408 nt, synthetic construct
  misc_feature 1..3408: note = derived and/or modified CDS sequence (wt) from DOBV(DOBV/Ano-Poroia/Afl9/1999)__NC_005234.1__IgE-leader_Gn -Gc
  source 1..3408: mol_type = other RNA
atggactggacctggatcctgttcctcgtggccgccgcgacccgcgtccacagcttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgacaagtttattttcaataatgcctggggtagcacattcaattgcaattgaattatgtgtaccagggttccatggttgggcaactgctgctctgctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacacaagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcctcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataa

SEQ ID NO: 16654 - RNA, 1290 nt, synthetic construct; identical to SEQ ID NO: 4919
  misc_feature 1..1290: note = derived and/or modified CDS sequence (opt4) from DOBV(DOBV/Ano-Poroia/Afl9/1999)__NC_005233.1__N
  source 1..1290: mol_type = other RNA

SEQ ID NO: 16655 - RNA, 3408 nt, synthetic construct; identical to SEQ ID NO: 8371
  misc_feature 1..3408: note = derived and/or modified CDS sequence (opt4) from DOBV(DOBV/Ano-Poroia/Afl9/1999)__NC_005234.1__GP
  source 1..3408: mol_type = other RNA

SEQ ID NO: 16656 - RNA, 3408 nt, synthetic construct
  misc_feature 1..3408: note = derived and/or modified CDS sequence (opt4) from DOBV(DOBV/Ano-Poroia/Afl9/1999)__NC_005234.1__IgE-leader_Gn -Gc
  source 1..3408: mol_type = other RNA
atggactggacctggatcctgttcctggtggccgccgccaccagagtgcacagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcgccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccagatcgtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccgtgatctacagccccggcctgttccccagactgaaccagagcagctgcgacaagatcgccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatcctgagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctga

SEQ ID NO: 16657 - RNA, 1290 nt, synthetic construct; identical to SEQ ID NO: 5611
  misc_feature 1..1290: note = derived and/or modified CDS sequence (opt3) from DOBV(DOBV/Ano-Poroia/Afl9/1999)__NC_005233.1__N
  source 1..1290: mol_type = other RNA

SEQ ID NO: 16658 - RNA, 3408 nt, synthetic construct; identical to SEQ ID NO: 10014
  misc_feature 1..3408: note = derived and/or modified CDS sequence (opt3) from DOBV(DOBV/Ano-Poroia/Afl9/1999)__NC_005234.1__GP
  source 1..3408: mol_type = other RNA

SEQ ID NO: 16659 - RNA, 3408 nt, synthetic construct
  misc_feature 1..3408: note = derived and/or modified CDS sequence (opt3) from DOBV(DOBV/Ano-Poroia/Afl9/1999)__NC_005234.1__IgE-leader_Gn -Gc
  source 1..3408: mol_type = other RNA
atggactggacctggatcctgttcctcgtggccgctgcaacaagagtccacagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcgcactgtcccaccggatggtggaggaatcttatcgcaatcgacgtagcgttatctgttacgacttgtcctgcaactcaacccattgtaagcccacaatgcacatgatagtgcctgtccatagttgcaatatgatgaaaagctgtctcgtggggctgggaccatatagaatccagattgtatacgagaggacctattgcactacaggcatcctgaccgaaggtaagtgttttgttcccgatcagtctattgtgaacgtcatcaaaaatggggtgttcgacatagcctccgtgtcaattgtctgctttttcatccgggttaagggaacgaactacaagattatggctagcatcaaaactgcaaccgccaataactgtaatgatacagacaacaaggtgcaaggctattacctctgcatcgtaggcgggaatagttctcctgtgtacgctccatccactaccgattttcgcagcatggaggccttagcgtcgctgcttagagcaccccacggagaggaccacgatttgtctggtgaagaggtcgccacatattccattgctggccagatagaagggaaaatccctcataccgccaacgcagctaacatgctgttcacggccttttcagggattccaagttacagctccctatctgtgttcatcggcagccaggacggtccggttatatattcacccgggctctttcctaggctgaatcagagttcctgcgacaagattgcgcttccactgatctgggagggatacatcgatttgcccggctattacgaaactgtgcacccttgtaacgtcttctgcgtgctcagcggcccaggggcctcttgtgaggcattttcagagggaggtattttcaatatcacaagtccgacctgcctggtaagcaaacaaaaccggttccgcgctgccgaacagcaggttaattttgtgtgtcagcgagtcgaccaagatattgtgatatattgcaacggccagaagaaaactatcttaacaaagaccctggtcattgggcagtgtatctactccgtgacgtctctcttctcgatcatgcccggagttgctcatagcattgccatagagctttgcgtgcctggctttcacggttgggcaaccgccgctctgttgacaactttctgttttgggtggatcctaattctgtccatcaccctcgcggtactggtcgtgcttaagttctttgcagccattctgcacaattcaagtcaagaaaacagattcaaaatcatattgaggaagatcaaagaggaatttgagaagacaaaaggctctatggtttgcgaggtgtgtaagtacgaatgcgagactggaaaggaactcaaagctcataatctgagctgcccccagtcccagtgtccatattgcttcacccactgtgagcctacagaatcagcctttcaggcacattacaaggtctgccaagccacccaccggttccgtgacgatctgaaaaagactattacgccccagagcacatctccaggctgttatcgcaccttaaacctatttagatacaaatccaggtgctatatcttcactgtgtgggtaaccctcctgattatcgagagtataatgtgggctgccagcgcatctgagacagtgcttgaaccctcctggaatgacaacgcgcatggggttggagtcgtgcctatgcacaccgatttggagctggacttctcactcccaagtagctcgaagtacacttataagcggaaactgacatccccgcttaatcaggaacagtctgtggatctgcacattgagatcgagagccaaggtatttcaacgagtgtccatgctttgggccactggtttgacgggcgactcaacctgaagacctccttccattgttacggagcctgcactaaatacgaatatccctggcacacagcaaagtgtcactttgagcgcgatttcgaatacgagaataactggggctgcaaccctgccgactgtccaggtatcgggaccggctgcacagcttgcggattatatatagaccagctgaaacccgttggctctgcctacaagctaatcactgtgagatatagcaggaaggtgtgtgtacagtttggggaagagaatctctgcaaaaccattgatatgaacgactgtttcgtcacgcggcatgtgaaggtttgcatcattggaaccgtgtccaaattttcacagggtgatacactggtcttccttggccctatggagggaggaggcttgatctttaaggactggtgtactagcacatgccaattcggtgatccaggggacataatgagtcccaaagataagggcttttcttgtccggacttcaccggacactttcgcaaaaagtgcaatttcgcaactacccctgtgtgtgaatacgatggcaacatggtttccgggtataagaaagtgatggctacgattgacagcttccagtcgtttaatacatcatctatccattacaccgatgagagaatcgaatggaaggacccagatggaatgctgaaagaccacctcaacattctggtaactaaggacatcgatttcgagaatttaggcgaaaacccctgcaaagtcggtctgcagacaagttccattgagggggcctggggaagcggcgtgggttttacccttacttgtcagatatctttgaccgagtgcagcaggttcctcacatccatcaaggcgtgcgacatggccatttgttacggcgctcaatcagtgacgctgatccgtgggcagaataccgtcaaggttagtggaaaaggcgggcatagcggatcttcctttaagtgctgtcacggcactgattgctcacagcaaggtctacaggcaagtgcccctcacctggacaaagtgaacgggattgtagaacaggagagcgaaaaggtgtatgatgacggagctccccagtgtggcatctcctgctggttcgtcaaatctggtgagtggataacaggcatctttaatgggaactggattgtgatcgttgtgctcgtcttctttttcattctgtcgcttatcttgctgagcttactctgtccaatacggaagcataagcgatcatga

SEQ ID NO: 16660 - RNA, 1290 nt, synthetic construct; identical to SEQ ID NO: 6303
  misc_feature 1..1290: note = derived and/or modified CDS sequence (opt1) from DOBV(DOBV/Ano-Poroia/Afl9/1999)__NC_005233.1__N
  source 1..1290: mol_type = other RNA

SEQ ID NO: 16661 - RNA, 3408 nt, synthetic construct; identical to SEQ ID NO: 11657
  misc_feature 1..3408: note = derived and/or modified CDS sequence (opt1) from DOBV(DOBV/Ano-Poroia/Afl9/1999)__NC_005234.1__GP
  source 1..3408: mol_type = other RNA

SEQ ID NO: 16662 - RNA, 3408 nt, synthetic construct
  misc_feature 1..3408: note = derived and/or modified CDS sequence (opt1) from DOBV(DOBV/Ano-Poroia/Afl9/1999)__NC_005234.1__IgE-leader_Gn -Gc
  source 1..3408: mol_type = other RNA
atggactggacctggatcctgttcctcgtggccgccgcgacccgcgtccacagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctga

SEQ ID NO: 16663 - RNA, 1290 nt, synthetic construct; identical to SEQ ID NO: 6995
  misc_feature 1..1290: note = derived and/or modified CDS sequence (opt5) from DOBV(DOBV/Ano-Poroia/Afl9/1999)__NC_005233.1__N
  source 1..1290: mol_type = other RNA

SEQ ID NO: 16664 - RNA, 3408 nt, synthetic construct; identical to SEQ ID NO: 13300
  misc_feature 1..3408: note = derived and/or modified CDS sequence (opt5) from DOBV(DOBV/Ano-Poroia/Afl9/1999)__NC_005234.1__GP
  source 1..3408: mol_type = other RNA

SEQ ID NO: 16665 - RNA, 3408 nt, synthetic construct
  misc_feature 1..3408: note = derived and/or modified CDS sequence (opt5) from DOBV(DOBV/Ano-Poroia/Afl9/1999)__NC_005234.1__IgE-leader_Gn -Gc
  source 1..3408: mol_type = other RNA
atggactggacctggatcctgttcctcgtggccgctgccacaagagtccacagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcgctctgtctcaccgcatggttgaggaatcctatagaaatcggcgcagcgtgatctgttacgacctctcttgcaactccacccattgtaagcctacaatgcacatgattgtccccgtgcatagctgcaatatgatgaaatcttgtctggttggacttggcccttatagaatccagattgtgtacgagcggacctattgcacgaccgggatcctgacagaaggaaagtgttttgtccccgatcagtccattgtgaacgtgatcaaaaatggcgtcttcgacattgccagcgtttccatcgtgtgctttttcatccgcgtgaagggcaccaactacaagattatggcttctatcaaaacagccaccgcgaataactgtaatgatacggacaacaaggtccaagggtattacctctgcattgtgggaggcaatagctcccctgtttacgccccgagcacaaccgattttagatctatggaggctctggcctcccttctgcgggctccccacggggaggaccacgatctcagcggagaagaggtggccacatattctatcgcgggccagattgaagggaaaatccctcataccgccaacgctgccaacatgctgttcaccgcttttagcggaatcccctcctactctagcctgtccgtcttcattggcagccaggacggccctgtgatctattctcccgggctctttccgcgcctgaatcagtccagctgcgacaagattgcccttcctctgatctgggagggatacattgatctccccggctattacgaaacagttcacccttgtaacgtgttctgcgtcctgtctgggcccggagcctcctgtgaggcttttagcgagggcgggatcttcaatatcacgtcccccacatgccttgtgtctaaacaaaacagattccgggcggccgaacagcaggtcaattttgtgtgtcagcgcgttgaccaagatattgtgatctattgcaacggacagaagaaaacaattctgaccaagacactcgtcatcggccagtgtatttacagcgtgacctccctgttctctatcatgcctggcgttgctcatagcattgccatcgagctgtgcgtgccggggtttcacggatgggccacggctgccctcctgacaaccttctgttttggctggatccttattctgtccatcaccctcgcggtcctggtggtgcttaagttctttgctgccattctgcacaatagctctcaagaaaacagattcaaaatcattctccggaagatcaaagaggaatttgagaagacaaaagggtccatggtttgcgaggtctgtaagtacgaatgcgagaccggaaaggaactgaaagcccataatctgagctgcccccagtctcagtgtccttattgcttcacacactgtgagcccacggaatccgcttttcaggcccattacaaggtgtgccaagctacccaccgcttcagagacgatctcaaaaagacaatcacccctcagagcacatctcccggctgttatcggaccctgaacctttttagatacaaaagccgctgctatattttcacggtgtgggtcaccctgctcatcattgagtccatcatgtgggccgcgagcgcctctgagacagtgctggaaccgtcctggaatgacaacgctcatggggttggcgtggtccctatgcacaccgatctggagcttgacttcagcctcccctcctctagcaagtacacatataagcggaaactgacctcccctctgaatcaggaacagtctgtggatctccacattgagatcgagagccaaggaatctccacgtctgttcatgccctgggccactggtttgacgggagacttaacctgaagaccagcttccattgttacggagcttgcaccaaatacgaatatccctggcacacagccaagtgtcactttgagcgcgatttcgaatacgagaataactggggctgcaaccctgcggactgtcccgggattggaaccggctgcaccgcctgcgggctctatatcgaccagctgaaaccggtgggctccgcttacaagctgattacagtccggtatagcagaaaggtgtgtgttcagtttggagaagagaatctttgcaaaacgatcgatatgaacgactgtttcgtgacccgccatgtcaaggtgtgcattatcggcacagtgtctaaattttcccagggggataccctcgtcttcctgggacctatggagggcgggggactgatctttaaggactggtgtacatctacctgccaattcggcgatcccggggacattatgagccccaaagataagggcttttcctgtcctgacttcacgggacactttcggaaaaagtgcaatttcgccacaaccccggtttgtgaatacgatggcaacatggtgagcgggtataagaaagtgatggctaccatcgactctttccagtcctttaatacaagctccattcattacaccgatgagagaatcgaatggaaggaccccgatggaatgctcaaagaccacctgaacattcttgtcacaaaggacatcgatttcgagaatctgggcgaaaacccttgcaaagtggggctccagacgagctctattgagggagcctggggcagcggggttggctttaccctgacatgtcagatctccctgaccgagtgctctcgcttccttacaagcatcaaggcctgcgacatggctatttgttacggagcgcaatccgtgaccctcatccggggccagaatacggtcaaggtgtctgggaaaggaggccatagcgggtcctcttttaagtgctgtcacggaaccgattgcagccagcaaggcctgcaggcctccgctccccacctggacaaagttaacggcattgtggaacaggagagcgaaaaggtctatgatgacggggcccctcagtgtggaatctcttgctggttcgtgaaatccggcgagtggattacagggatctttaatggaaactggatcgttattgtggtcctcgtgttctttttcatcctgagccttattctgctctctctgctgtgtcccatcagaaagcataagcgctcctga

SEQ ID NO: 16666 - RNA, 1290 nt, synthetic construct; identical to SEQ ID NO: 7687
  misc_feature 1..1290: note = derived and/or modified CDS sequence (opt11) from DOBV(DOBV/Ano-Poroia/Afl9/1999)__NC_005233.1__N
  source 1..1290: mol_type = other RNA

SEQ ID NO: 16667 - RNA, 3408 nt, synthetic construct; identical to SEQ ID NO: 11657
  misc_feature 1..3408: note = derived and/or modified CDS sequence (opt11) from DOBV(DOBV/Ano-Poroia/Afl9/1999)__NC_005234.1__GP
  source 1..3408: mol_type = other RNA

SEQ ID NO: 16668 - RNA, 3408 nt, synthetic construct
  misc_feature 1..3408: note = derived and/or modified CDS sequence (opt11) from DOBV(DOBV/Ano-Poroia/Afl9/1999)__NC_005234.1__IgE-leader_Gn -Gc
  source 1..3408: mol_type = other RNA
atggattggacgtggatactctttctcgtggccgcggccacgcgcgtgcactcgctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctga

SEQ ID NO: 16669 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (wt)
  source 1..1507: mol_type = other RNA
gggagaaagcttaccatggcaacattagaggaactccaaaaagaaatcaacaaccacgagggccaattggtgatagccaggcagaaggtgaaagatgcagaaaagcagtatgaaaaggatcctgacgacctgaataaaagggcattgagtgaccgggaaagcattgcacaatcaattcagggaaaaatagatgaattaaggagacagctggctgatcgtgtggcagcagggaaaaacattggcaaagagagggacccaactggactagaccctggagatcacctcaaagagaagtcaatgctcagttatggaaatgtcattgacctcaaccatcttgacattgatgaacctacagggcaaaccgcagactggctgagcattgtggtctacctgacatcattcgtggttccaatattgttgaaggctctttacatgcttaccaccagagggagacaaactactaaagacaataagggaatgagaattcgatttaaggatgacagctcttttgaagatgtgaatgggattagaaagccaaagcacctgttcttgtcaatgcccaatgcacaatctagcatgaaggcagatgagattacaccaggtcggttcaggactgcaatttgtggactatacccagcccaggtgaaggcaaggaacttaatcagtcctgtgatgagtgtgattgggtttttagcccttgcaaagaactggacagagcgggttgaggaatggcttgacctcccgtgcaagctactatctgagccatctccaacgtctttgaccaaaggcccatccaccaatcgtgactacttgaatcaaagacaaggagcgcttgcaaaaatggaaacaaaagaagctcaggctgtgaggaaacatgccatagatgctggctgcaaccttatcgaccatatagactcaccatcatcaatctgggtctttgcaggagcacccgacagatgccctcctacctgcctgttcattgcaggcatggcagagctaggtgcattctttgctgttctccaggatatgaggaacaccatcatggcgtcaaaaactatcggaacatctgaggagaagctaaagaagaaatcatctttttaccaatcttacctacggaggacacaatctatggggatacaactggaccagcgcatcatcgtgctcttcatggttgactggggaaaagaggcagttgatagttttcatcttggtgatgatatggatcctgagctccggggcctggcacaggcattaattgatcaaaaagtgaaggaaatatctaatcaggaaccgcttaagctttaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16670 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (wt)
  source 1..1507: mol_type = other RNA
gggagaaagcttaccatggcaacattagaggaactccaaaaagaaatcaacaaccacgagggccaattggtgatagccaggcagaaggtgaaagatgcagaaaagcagtatgaaaaggatcctgacgacctgaataaaagggcattgagtgaccgggaaagcattgcacaatcaattcagggaaaaatagatgaattaaggagacagctggctgatcgtgtggcagcagggaaaaacattggcaaagagagggacccaactggactagaccctggagatcacctcaaagagaagtcaatgctcagttatggaaatgtcattgacctcaaccatcttgacattgatgaacctacagggcaaaccgcagactggctgagcattgtggtctacctgacatcattcgtggttccaatattgttgaaggctctttacatgcttaccaccagagggagacaaactactaaagacaataagggaatgagaatccgatttaaggatgacagctcttttgaagatgtgaatgggattagaaagccaaagcacctgttcttgtcaatgcccaatgcacaatctagcatgaaggcagatgagattacaccaggtcggttcaggactgcaatttgtggactatacccagcccaggtgaaggcaaggaacttaatcagtcctgtgatgagtgtgattgggtttttagcccttgcaaagaactggacagagcgggttgaggaatggcttgacctcccgtgcaagctactatctgagccatctccaacgtctttgaccaaaggcccatccaccaatcgtgactacttgaatcaaagacaaggagcgcttgcaaaaatggaaacaaaagaagctcaggctgtgaggaaacatgccatagatgctggctgcaaccttatcgaccatatagactcaccatcatcaatctgggtctttgcaggagcacccgacagatgccctcctacctgcctgttcattgcaggcatggcagagctaggtgcattctttgctgttctccaggatatgaggaacaccatcatggcgtcaaaaactatcggaacatctgaggagaagctaaagaagaaatcatctttttaccaatcttacctacggaggacacaatctatggggatacaactggaccagcgcatcatcgtgctgttcatggttgactggggaaaagaggcagttgatagttttcatcttggtgatgatatggatcctgagctccggggcctggcacaggcattaattgatcaaaaagtgaaggaaatatctaatcaggaaccgcttaagctgtaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16671 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__GP (wt)
  source 1..3625: mol_type = other RNA
gggagaaagcttaccatgatcatgtggggtttactattgacaatgattttgatcgattttggggcatccttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgactagtttattttcaataatgcctggggtagcacattcaattgcaattgaattatgtgtaccagggttccatggttgggcaactgctgctcttctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacactagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcttcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16672 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__GP (wt)
  source 1..3625: mol_type = other RNA
gggagaaagcttaccatgatcatgtggggtttactattgacaatgattttgatcgattttggggcatccttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgacaagtttattttcaataatgcctggggtagcacattcaattgcaattgaattatgtgtaccagggttccatggttgggcaactgctgctctgctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacacaagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcctcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16673 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (wt)
  source 1..3625: mol_type = other RNA
gggagaaagcttaccatggactggacctggatcctgttcctcgtggccgccgcgacccgcgtccacagcttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgactagtttattttcaataatgcctggggtagcacattcaattgcaattgaattatgtgtaccagggttccatggttgggcaactgctgctcttctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacactagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcttcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16674 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (wt)
  source 1..3625: mol_type = other RNA
gggagaaagcttaccatggactggacctggatcctgttcctcgtggccgccgcgacccgcgtccacagcttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgacaagtttattttcaataatgcctggggtagcacattcaattgcaattgaattatgtgtaccagggttccatggttgggcaactgctgctctgctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacacaagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcctcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16675 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (opt4)
  source 1..1507: mol_type = other RNA
gggagaaagcttaccatggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16676 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__GP (opt4)
  source 1..3625: mol_type = other RNA
gggagaaagcttaccatgatcatgtggggcctgctgctgaccatgatcctgatcgacttcggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcgccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccagatcgtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccgtgatctacagccccggcctgttccccagactgaaccagagcagctgcgacaagatcgccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatcctgagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16677 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (opt4)
  source 1..3625: mol_type = other RNA
gggagaaagcttaccatggactggacctggatcctgttcctggtggccgccgccaccagagtgcacagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcgccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccagatcgtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccgtgatctacagccccggcctgttccccagactgaaccagagcagctgcgacaagatcgccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatcctgagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16678 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (opt3)
  source 1..1507: mol_type = other RNA
gggagaaagcttaccatggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtagtgtacctcacctccttcgtcgtgcccatcctgctgaaggctctctatatgttaacaactaggggtcggcagaccacaaaagacaacaaggggatgcgcattagatttaaggacgattcttcgttcgaggacgttaatggaatcaggaaacctaagcatctgtttctttcaatgccaaacgcacaaagcagtatgaaagccgatgagattacccccggccggttccgcactgctatctgcggcttgtaccctgcccaggtgaaggcgcgaaatctgatatccccagtcatgtctgtgattgggtttctagcactcgccaaaaactggacagaaagagtagaggaatggctggaccttccctgtaagctgttgagcgagccttccccaacctcactcacgaaaggaccgagtactaatagggattatctgaaccagcggcagggtgctttagccaagatggaaaccaaggaggcacaagctgttcgtaaacacgccatcgacgcgggctgcaatctgattgatcatatcgacagcccctcttccatctgggtgttcgccggggcacctgatcgctgtccacccacatgcctctttattgctggaatggccgagcttggcgctttctttgccgtcctgcaggacatgagaaacactataatggcatcaaagaccatcggtacaagcgaagagaaattgaagaaaaagagttctttctaccagtcctatctaaggcggacccaaagcatggggattcagctggatcagcgaatcatagtgctctttatggtggactggggaaaggaagccgtcgactcgttccacctgggcgatgacatggatcctgagcttcgcggcctggctcaggcgttgattgaccaaaaagttaaggaaatctctaatcaggagccactcaaactgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16679 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__GP (opt3)
  source 1..3625: mol_type = other RNA
gggagaaagcttaccatgatcatgtggggcctgctccttaccatgattctgatagacttcggggccagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcgcactgtcccaccggatggtggaggaatcttatcgcaatcgacgtagcgttatctgttacgacttgtcctgcaactcaacccattgtaagcccacaatgcacatgatagtgcctgtccatagttgcaatatgatgaaaagctgtctcgtggggctgggaccatatagaatccagattgtatacgagaggacctattgcactacaggcatcctgaccgaaggtaagtgttttgttcccgatcagtctattgtgaacgtcatcaaaaatggggtgttcgacatagcctccgtgtcaattgtctgctttttcatccgggttaagggaacgaactacaagattatggctagcatcaaaactgcaaccgccaataactgtaatgatacagacaacaaggtgcaaggctattacctctgcatcgtaggcgggaatagttctcctgtgtacgctccatccactaccgattttcgcagcatggaggccttagcgtcgctgcttagagcaccccacggagaggaccacgatttgtctggtgaagaggtcgccacatattccattgctggccagatagaagggaaaatccctcataccgccaacgcagctaacatgctgttcacggccttttcagggattccaagttacagctccctatctgtgttcatcggcagccaggacggtccggttatatattcacccgggctctttcctaggctgaatcagagttcctgcgacaagattgcgcttccactgatctgggagggatacatcgatttgcccggctattacgaaactgtgcacccttgtaacgtcttctgcgtgctcagcggcccaggggcctcttgtgaggcattttcagagggaggtattttcaatatcacaagtccgacctgcctggtaagcaaacaaaaccggttccgcgctgccgaacagcaggttaattttgtgtgtcagcgagtcgaccaagatattgtgatatattgcaacggccagaagaaaactatcttaacaaagaccctggtcattgggcagtgtatctactccgtgacgtctctcttctcgatcatgcccggagttgctcatagcattgccatagagctttgcgtgcctggctttcacggttgggcaaccgccgctctgttgacaactttctgttttgggtggatcctaattctgtccatcaccctcgcggtactggtcgtgcttaagttctttgcagccattctgcacaattcaagtcaagaaaacagattcaaaatcatattgaggaagatcaaagaggaatttgagaagacaaaaggctctatggtttgcgaggtgtgtaagtacgaatgcgagactggaaaggaactcaaagctcataatctgagctgcccccagtcccagtgtccatattgcttcacccactgtgagcctacagaatcagcctttcaggcacattacaaggtctgccaagccacccaccggttccgtgacgatctgaaaaagactattacgccccagagcacatctccaggctgttatcgcaccttaaacctatttagatacaaatccaggtgctatatcttcactgtgtgggtaaccctcctgattatcgagagtataatgtgggctgccagcgcatctgagacagtgcttgaaccctcctggaatgacaacgcgcatggggttggagtcgtgcctatgcacaccgatttggagctggacttctcactcccaagtagctcgaagtacacttataagcggaaactgacatccccgcttaatcaggaacagtctgtggatctgcacattgagatcgagagccaaggtatttcaacgagtgtccatgctttgggccactggtttgacgggcgactcaacctgaagacctccttccattgttacggagcctgcactaaatacgaatatccctggcacacagcaaagtgtcactttgagcgcgatttcgaatacgagaataactggggctgcaaccctgccgactgtccaggtatcgggaccggctgcacagcttgcggattatatatagaccagctgaaacccgttggctctgcctacaagctaatcactgtgagatatagcaggaaggtgtgtgtacagtttggggaagagaatctctgcaaaaccattgatatgaacgactgtttcgtcacgcggcatgtgaaggtttgcatcattggaaccgtgtccaaattttcacagggtgatacactggtcttccttggccctatggagggaggaggcttgatctttaaggactggtgtactagcacatgccaattcggtgatccaggggacataatgagtcccaaagataagggcttttcttgtccggacttcaccggacactttcgcaaaaagtgcaatttcgcaactacccctgtgtgtgaatacgatggcaacatggtttccgggtataagaaagtgatggctacgattgacagcttccagtcgtttaatacatcatctatccattacaccgatgagagaatcgaatggaaggacccagatggaatgctgaaagaccacctcaacattctggtaactaaggacatcgatttcgagaatttaggcgaaaacccctgcaaagtcggtctgcagacaagttccattgagggggcctggggaagcggcgtgggttttacccttacttgtcagatatctttgaccgagtgcagcaggttcctcacatccatcaaggcgtgcgacatggccatttgttacggcgctcaatcagtgacgctgatccgtgggcagaataccgtcaaggttagtggaaaaggcgggcatagcggatcttcctttaagtgctgtcacggcactgattgctcacagcaaggtctacaggcaagtgcccctcacctggacaaagtgaacgggattgtagaacaggagagcgaaaaggtgtatgatgacggagctccccagtgtggcatctcctgctggttcgtcaaatctggtgagtggataacaggcatctttaatgggaactggattgtgatcgttgtgctcgtcttctttttcattctgtcgcttatcttgctgagcttactctgtccaatacggaagcataagcgatcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16680 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (opt3)
  source 1..3625: mol_type = other RNA
gggagaaagcttaccatggactggacctggatcctgttcctcgtggccgctgcaacaagagtccacagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcgcactgtcccaccggatggtggaggaatcttatcgcaatcgacgtagcgttatctgttacgacttgtcctgcaactcaacccattgtaagcccacaatgcacatgatagtgcctgtccatagttgcaatatgatgaaaagctgtctcgtggggctgggaccatatagaatccagattgtatacgagaggacctattgcactacaggcatcctgaccgaaggtaagtgttttgttcccgatcagtctattgtgaacgtcatcaaaaatggggtgttcgacatagcctccgtgtcaattgtctgctttttcatccgggttaagggaacgaactacaagattatggctagcatcaaaactgcaaccgccaataactgtaatgatacagacaacaaggtgcaaggctattacctctgcatcgtaggcgggaatagttctcctgtgtacgctccatccactaccgattttcgcagcatggaggccttagcgtcgctgcttagagcaccccacggagaggaccacgatttgtctggtgaagaggtcgccacatattccattgctggccagatagaagggaaaatccctcataccgccaacgcagctaacatgctgttcacggccttttcagggattccaagttacagctccctatctgtgttcatcggcagccaggacggtccggttatatattcacccgggctctttcctaggctgaatcagagttcctgcgacaagattgcgcttccactgatctgggagggatacatcgatttgcccggctattacgaaactgtgcacccttgtaacgtcttctgcgtgctcagcggcccaggggcctcttgtgaggcattttcagagggaggtattttcaatatcacaagtccgacctgcctggtaagcaaacaaaaccggttccgcgctgccgaacagcaggttaattttgtgtgtcagcgagtcgaccaagatattgtgatatattgcaacggccagaagaaaactatcttaacaaagaccctggtcattgggcagtgtatctactccgtgacgtctctcttctcgatcatgcccggagttgctcatagcattgccatagagctttgcgtgcctggctttcacggttgggcaaccgccgctctgttgacaactttctgttttgggtggatcctaattctgtccatcaccctcgcggtactggtcgtgcttaagttctttgcagccattctgcacaattcaagtcaagaaaacagattcaaaatcatattgaggaagatcaaagaggaatttgagaagacaaaaggctctatggtttgcgaggtgtgtaagtacgaatgcgagactggaaaggaactcaaagctcataatctgagctgcccccagtcccagtgtccatattgcttcacccactgtgagcctacagaatcagcctttcaggcacattacaaggtctgccaagccacccaccggttccgtgacgatctgaaaaagactattacgccccagagcacatctccaggctgttatcgcaccttaaacctatttagatacaaatccaggtgctatatcttcactgtgtgggtaaccctcctgattatcgagagtataatgtgggctgccagcgcatctgagacagtgcttgaaccctcctggaatgacaacgcgcatggggttggagtcgtgcctatgcacaccgatttggagctggacttctcactcccaagtagctcgaagtacacttataagcggaaactgacatccccgcttaatcaggaacagtctgtggatctgcacattgagatcgagagccaaggtatttcaacgagtgtccatgctttgggccactggtttgacgggcgactcaacctgaagacctccttccattgttacggagcctgcactaaatacgaatatccctggcacacagcaaagtgtcactttgagcgcgatttcgaatacgagaataactggggctgcaaccctgccgactgtccaggtatcgggaccggctgcacagcttgcggattatatatagaccagctgaaacccgttggctctgcctacaagctaatcactgtgagatatagcaggaaggtgtgtgtacagtttggggaagagaatctctgcaaaaccattgatatgaacgactgtttcgtcacgcggcatgtgaaggtttgcatcattggaaccgtgtccaaattttcacagggtgatacactggtcttccttggccctatggagggaggaggcttgatctttaaggactggtgtactagcacatgccaattcggtgatccaggggacataatgagtcccaaagataagggcttttcttgtccggacttcaccggacactttcgcaaaaagtgcaatttcgcaactacccctgtgtgtgaatacgatggcaacatggtttccgggtataagaaagtgatggctacgattgacagcttccagtcgtttaatacatcatctatccattacaccgatgagagaatcgaatggaaggacccagatggaatgctgaaagaccacctcaacattctggtaactaaggacatcgatttcgagaatttaggcgaaaacccctgcaaagtcggtctgcagacaagttccattgagggggcctggggaagcggcgtgggttttacccttacttgtcagatatctttgaccgagtgcagcaggttcctcacatccatcaaggcgtgcgacatggccatttgttacggcgctcaatcagtgacgctgatccgtgggcagaataccgtcaaggttagtggaaaaggcgggcatagcggatcttcctttaagtgctgtcacggcactgattgctcacagcaaggtctacaggcaagtgcccctcacctggacaaagtgaacgggattgtagaacaggagagcgaaaaggtgtatgatgacggagctccccagtgtggcatctcctgctggttcgtcaaatctggtgagtggataacaggcatctttaatgggaactggattgtgatcgttgtgctcgtcttctttttcattctgtcgcttatcttgctgagcttactctgtccaatacggaagcataagcgatcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16681 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (opt1)
  source 1..1507: mol_type = other RNA
gggagaaagcttaccatggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcgtgtacctcaccagcttcgtggtccccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtcatgtccgtgatcggcttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggggccctggccaagatggagaccaaggaggcccaggccgtccgcaagcacgcgatcgacgccggctgcaacctcatcgaccacatcgacagcccctccagcatctgggtgttcgccggggcccccgaccggtgcccgccgacctgcctgttcatcgccggcatggcggagctgggcgccttcttcgccgtgctccaggacatgcgcaacaccatcatggccagcaagacgatcgggacctccgaggagaagctgaagaagaagtccagcttctaccagagctacctgcggcgcacccagtccatgggcatccagctcgaccagcgcatcatcgtcctgttcatggtggactgggggaaggaggccgtggacagcttccacctgggcgacgacatggaccccgagctccgggggctggcgcaggccctgatcgaccagaaggtcaaggagatctccaaccaggagcccctcaagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16682 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__GP (opt1)
  source 1..3625: mol_type = other RNA
gggagaaagcttaccatgatcatgtggggcctgctcctgaccatgatcctgatcgacttcggggccagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16683 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (opt1)
  source 1..3625: mol_type = other RNA
gggagaaagcttaccatggactggacctggatcctgttcctcgtggccgccgcgacccgcgtccacagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16684 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (opt5)
  source 1..1507: mol_type = other RNA
gggagaaagcttaccatggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtggtctacctgaccagcttcgtggttcctatccttctgaaggctctctatatgctgacaacacggggacgccagaccacaaaagacaacaagggcatgcggattagatttaaggacgattcctctttcgaggacgtgaatggcatccgcaaacccaagcatctttttctgagcatgcctaacgcccaatccagcatgaaagcggatgagattacccccgggagattccggacggccatctgcggactctaccctgctcaggtcaaggcccgcaatctgatttctccggtgatgtccgttatcggctttctggctctcgccaaaaactggaccgaaagagtggaggaatggctggaccttccctgtaagctgctcagcgagccttctcccacatccctgaccaaagggcctagcacaaatcgggattatcttaaccagcgccagggagcgctggccaagatggaaaccaaggaggctcaagccgtcagaaaacacgctatcgacgccggctgcaatctcattgatcatatcgactctccctccagcatttgggtgttcgccggggctccggatcggtgtcctcccacgtgcctgtttatcgcgggaatggccgagctgggcgctttctttgccgtgctccaggacatgagaaacacaattatggcctccaagaccatcggcacatctgaagagaaactgaagaaaaagagctccttctaccagagctatcttcgccggacccaatctatggggatccagctggatcagagaattatcgtcctctttatggttgactggggaaaggaagctgtggactccttccacctgggcgatgacatggatcctgagcttcgcgggctggcccaggcgctcattgaccaaaaagtgaaggaaatcagcaatcaggagcccctgaaactgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16685 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__GP (opt5)
  source 1..3625: mol_type = other RNA
gggagaaagcttaccatgatcatgtggggcctgctcctgaccatgattcttatcgacttcggggccagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcgctctgtctcaccgcatggttgaggaatcctatagaaatcggcgcagcgtgatctgttacgacctctcttgcaactccacccattgtaagcctacaatgcacatgattgtccccgtgcatagctgcaatatgatgaaatcttgtctggttggacttggcccttatagaatccagattgtgtacgagcggacctattgcacgaccgggatcctgacagaaggaaagtgttttgtccccgatcagtccattgtgaacgtgatcaaaaatggcgtcttcgacattgccagcgtttccatcgtgtgctttttcatccgcgtgaagggcaccaactacaagattatggcttctatcaaaacagccaccgcgaataactgtaatgatacggacaacaaggtccaagggtattacctctgcattgtgggaggcaatagctcccctgtttacgccccgagcacaaccgattttagatctatggaggctctggcctcccttctgcgggctccccacggggaggaccacgatctcagcggagaagaggtggccacatattctatcgcgggccagattgaagggaaaatccctcataccgccaacgctgccaacatgctgttcaccgcttttagcggaatcccctcctactctagcctgtccgtcttcattggcagccaggacggccctgtgatctattctcccgggctctttccgcgcctgaatcagtccagctgcgacaagattgcccttcctctgatctgggagggatacattgatctccccggctattacgaaacagttcacccttgtaacgtgttctgcgtcctgtctgggcccggagcctcctgtgaggcttttagcgagggcgggatcttcaatatcacgtcccccacatgccttgtgtctaaacaaaacagattccgggcggccgaacagcaggtcaattttgtgtgtcagcgcgttgaccaagatattgtgatctattgcaacggacagaagaaaacaattctgaccaagacactcgtcatcggccagtgtatttacagcgtgacctccctgttctctatcatgcctggcgttgctcatagcattgccatcgagctgtgcgtgccggggtttcacggatgggccacggctgccctcctgacaaccttctgttttggctggatccttattctgtccatcaccctcgcggtcctggtggtgcttaagttctttgctgccattctgcacaatagctctcaagaaaacagattcaaaatcattctccggaagatcaaagaggaatttgagaagacaaaagggtccatggtttgcgaggtctgtaagtacgaatgcgagaccggaaaggaactgaaagcccataatctgagctgcccccagtctcagtgtccttattgcttcacacactgtgagcccacggaatccgcttttcaggcccattacaaggtgtgccaagctacccaccgcttcagagacgatctcaaaaagacaatcacccctcagagcacatctcccggctgttatcggaccctgaacctttttagatacaaaagccgctgctatattttcacggtgtgggtcaccctgctcatcattgagtccatcatgtgggccgcgagcgcctctgagacagtgctggaaccgtcctggaatgacaacgctcatggggttggcgtggtccctatgcacaccgatctggagcttgacttcagcctcccctcctctagcaagtacacatataagcggaaactgacctcccctctgaatcaggaacagtctgtggatctccacattgagatcgagagccaaggaatctccacgtctgttcatgccctgggccactggtttgacgggagacttaacctgaagaccagcttccattgttacggagcttgcaccaaatacgaatatccctggcacacagccaagtgtcactttgagcgcgatttcgaatacgagaataactggggctgcaaccctgcggactgtcccgggattggaaccggctgcaccgcctgcgggctctatatcgaccagctgaaaccggtgggctccgcttacaagctgattacagtccggtatagcagaaaggtgtgtgttcagtttggagaagagaatctttgcaaaacgatcgatatgaacgactgtttcgtgacccgccatgtcaaggtgtgcattatcggcacagtgtctaaattttcccagggggataccctcgtcttcctgggacctatggagggcgggggactgatctttaaggactggtgtacatctacctgccaattcggcgatcccggggacattatgagccccaaagataagggcttttcctgtcctgacttcacgggacactttcggaaaaagtgcaatttcgccacaaccccggtttgtgaatacgatggcaacatggtgagcgggtataagaaagtgatggctaccatcgactctttccagtcctttaatacaagctccattcattacaccgatgagagaatcgaatggaaggaccccgatggaatgctcaaagaccacctgaacattcttgtcacaaaggacatcgatttcgagaatctgggcgaaaacccttgcaaagtggggctccagacgagctctattgagggagcctggggcagcggggttggctttaccctgacatgtcagatctccctgaccgagtgctctcgcttccttacaagcatcaaggcctgcgacatggctatttgttacggagcgcaatccgtgaccctcatccggggccagaatacggtcaaggtgtctgggaaaggaggccatagcgggtcctcttttaagtgctgtcacggaaccgattgcagccagcaaggcctgcaggcctccgctccccacctggacaaagttaacggcattgtggaacaggagagcgaaaaggtctatgatgacggggcccctcagtgtggaatctcttgctggttcgtgaaatccggcgagtggattacagggatctttaatggaaactggatcgttattgtggtcctcgtgttctttttcatcctgagccttattctgctctctctgctgtgtcccatcagaaagcataagcgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16686 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (opt5)
  source 1..3625: mol_type = other RNA
gggagaaagcttaccatggactggacctggatcctgttcctcgtggccgctgccacaagagtccacagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcgctctgtctcaccgcatggttgaggaatcctatagaaatcggcgcagcgtgatctgttacgacctctcttgcaactccacccattgtaagcctacaatgcacatgattgtccccgtgcatagctgcaatatgatgaaatcttgtctggttggacttggcccttatagaatccagattgtgtacgagcggacctattgcacgaccgggatcctgacagaaggaaagtgttttgtccccgatcagtccattgtgaacgtgatcaaaaatggcgtcttcgacattgccagcgtttccatcgtgtgctttttcatccgcgtgaagggcaccaactacaagattatggcttctatcaaaacagccaccgcgaataactgtaatgatacggacaacaaggtccaagggtattacctctgcattgtgggaggcaatagctcccctgtttacgccccgagcacaaccgattttagatctatggaggctctggcctcccttctgcgggctccccacggggaggaccacgatctcagcggagaagaggtggccacatattctatcgcgggccagattgaagggaaaatccctcataccgccaacgctgccaacatgctgttcaccgcttttagcggaatcccctcctactctagcctgtccgtcttcattggcagccaggacggccctgtgatctattctcccgggctctttccgcgcctgaatcagtccagctgcgacaagattgcccttcctctgatctgggagggatacattgatctccccggctattacgaaacagttcacccttgtaacgtgttctgcgtcctgtctgggcccggagcctcctgtgaggcttttagcgagggcgggatcttcaatatcacgtcccccacatgccttgtgtctaaacaaaacagattccgggcggccgaacagcaggtcaattttgtgtgtcagcgcgttgaccaagatattgtgatctattgcaacggacagaagaaaacaattctgaccaagacactcgtcatcggccagtgtatttacagcgtgacctccctgttctctatcatgcctggcgttgctcatagcattgccatcgagctgtgcgtgccggggtttcacggatgggccacggctgccctcctgacaaccttctgttttggctggatccttattctgtccatcaccctcgcggtcctggtggtgcttaagttctttgctgccattctgcacaatagctctcaagaaaacagattcaaaatcattctccggaagatcaaagaggaatttgagaagacaaaagggtccatggtttgcgaggtctgtaagtacgaatgcgagaccggaaaggaactgaaagcccataatctgagctgcccccagtctcagtgtccttattgcttcacacactgtgagcccacggaatccgcttttcaggcccattacaaggtgtgccaagctacccaccgcttcagagacgatctcaaaaagacaatcacccctcagagcacatctcccggctgttatcggaccctgaacctttttagatacaaaagccgctgctatattttcacggtgtgggtcaccctgctcatcattgagtccatcatgtgggccgcgagcgcctctgagacagtgctggaaccgtcctggaatgacaacgctcatggggttggcgtggtccctatgcacaccgatctggagcttgacttcagcctcccctcctctagcaagtacacatataagcggaaactgacctcccctctgaatcaggaacagtctgtggatctccacattgagatcgagagccaaggaatctccacgtctgttcatgccctgggccactggtttgacgggagacttaacctgaagaccagcttccattgttacggagcttgcaccaaatacgaatatccctggcacacagccaagtgtcactttgagcgcgatttcgaatacgagaataactggggctgcaaccctgcggactgtcccgggattggaaccggctgcaccgcctgcgggctctatatcgaccagctgaaaccggtgggctccgcttacaagctgattacagtccggtatagcagaaaggtgtgtgttcagtttggagaagagaatctttgcaaaacgatcgatatgaacgactgtttcgtgacccgccatgtcaaggtgtgcattatcggcacagtgtctaaattttcccagggggataccctcgtcttcctgggacctatggagggcgggggactgatctttaaggactggtgtacatctacctgccaattcggcgatcccggggacattatgagccccaaagataagggcttttcctgtcctgacttcacgggacactttcggaaaaagtgcaatttcgccacaaccccggtttgtgaatacgatggcaacatggtgagcgggtataagaaagtgatggctaccatcgactctttccagtcctttaatacaagctccattcattacaccgatgagagaatcgaatggaaggaccccgatggaatgctcaaagaccacctgaacattcttgtcacaaaggacatcgatttcgagaatctgggcgaaaacccttgcaaagtggggctccagacgagctctattgagggagcctggggcagcggggttggctttaccctgacatgtcagatctccctgaccgagtgctctcgcttccttacaagcatcaaggcctgcgacatggctatttgttacggagcgcaatccgtgaccctcatccggggccagaatacggtcaaggtgtctgggaaaggaggccatagcgggtcctcttttaagtgctgtcacggaaccgattgcagccagcaaggcctgcaggcctccgctccccacctggacaaagttaacggcattgtggaacaggagagcgaaaaggtctatgatgacggggcccctcagtgtggaatctcttgctggttcgtgaaatccggcgagtggattacagggatctttaatggaaactggatcgttattgtggtcctcgtgttctttttcatcctgagccttattctgctctctctgctgtgtcccatcagaaagcataagcgctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16687 - RNA, 1507 nt, synthetic construct
  misc_feature 1..1507: note = mRNA product Design1 comprising derived and/or modified sequence from DOBV(DOBV/Ano-Poroia/Afl9/1999)__NC_005233.1__N (opt11)
  source 1..1507: mol_type = other RNA
gggagaaagcttaccatggccaccctagaagaactccaaaaagaaatcaacaaccacgaaggacaactcgtaatcgcacgccaaaaagtcaaagacgccgaaaaacaatacgaaaaagaccccgacgatcttaacaaacgagcactctcagaccgcgaaagcatcgcccaaagcatccaaggaaaaatagacgaactccgccgtcaactcgcagaccgagtcgcagcaggcaaaaacatcggaaaagaacgcgaccctaccggccttgacccaggcgaccacctgaaagaaaaatcaatgctaagctacggcaacgtcatcgaccttaaccacctagacattgacgagccaacaggccaaaccgccgactggctatccatcgtcgtatacctgacctcattcgtagtccccatcctcctaaaagccctctacatgctcaccacccgcggcagacaaacaaccaaagacaacaaaggcatgagaatacgcttcaaagacgacagttccttcgaagacgttaacggcatcagaaaacccaaacacctctttctctccatgcccaacgcacaatcctcaatgaaagccgacgaaatcacacctggccgcttccgaaccgccatctgcggactctaccccgcacaagtcaaagccagaaacctcatctcccccgtcatgtccgtcataggattcctcgccctcgccaaaaactggacagaacgcgtcgaagaatggctagacctaccctgcaaactcttatccgagcccagccccacctccctcacaaaaggcccctcaacaaaccgcgactacctcaaccaacgccaaggtgcactcgcaaaaatggaaactaaagaagcccaagccgtccgcaaacacgccatcgacgccggctgcaacctcatcgaccacatcgacagcccgagctccatctgggtcttcgccggcgcaccagaccgctgcccaccaacctgcctcttcatcgccggcatggcagaactcggcgccttcttcgccgtactccaagacatgcgtaacaccatcatggcaagcaagaccatcggaacctccgaagaaaaacttaagaaaaagtcatcattctaccaatcctacctccgccgaacccaaagcatgggcatccaactagaccagcgcataatcgtcctcttcatggtcgactggggaaaagaagcagtcgattccttccacctcggagacgacatggacccagagctacgaggcctcgcgcaagccctcatagaccaaaaagtaaaagagatctccaatcaagaaccactcaaactctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16688 - RNA, 3625 nt, synthetic construct; identical to SEQ ID NO: 16682
  misc_feature 1..3625: note = mRNA product Design1 comprising derived and/or modified sequence from DOBV(DOBV/Ano-Poroia/Afl9/1999)__NC_005234.1__GP (opt11)
  source 1..3625: mol_type = other RNA

SEQ ID NO: 16689 - RNA, 3625 nt, synthetic construct
  misc_feature 1..3625: note = mRNA product Design1 comprising derived and/or modified sequence from DOBV(DOBV/Ano-Poroia/Afl9/1999)__NC_005234.1__IgE-leader_Gn -Gc (opt11)
  source 1..3625: mol_type = other RNA
gggagaaagcttaccatggattggacgtggatactctttctcgtggccgcggccacgcgcgtgcactcgctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16690 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (wt)
  source 1..1672: mol_type = other RNA
ggggcgctgcctacggaggtggcagccatctccttctcggcatcaagcttaccatggcaacattagaggaactccaaaaagaaatcaacaaccacgagggccaattggtgatagccaggcagaaggtgaaagatgcagaaaagcagtatgaaaaggatcctgacgacctgaataaaagggcattgagtgaccgggaaagcattgcacaatcaattcagggaaaaatagatgaattaaggagacagctggctgatcgtgtggcagcagggaaaaacattggcaaagagagggacccaactggactagaccctggagatcacctcaaagagaagtcaatgctcagttatggaaatgtcattgacctcaaccatcttgacattgatgaacctacagggcaaaccgcagactggctgagcattgtggtctacctgacatcattcgtggttccaatattgttgaaggctctttacatgcttaccaccagagggagacaaactactaaagacaataagggaatgagaattcgatttaaggatgacagctcttttgaagatgtgaatgggattagaaagccaaagcacctgttcttgtcaatgcccaatgcacaatctagcatgaaggcagatgagattacaccaggtcggttcaggactgcaatttgtggactatacccagcccaggtgaaggcaaggaacttaatcagtcctgtgatgagtgtgattgggtttttagcccttgcaaagaactggacagagcgggttgaggaatggcttgacctcccgtgcaagctactatctgagccatctccaacgtctttgaccaaaggcccatccaccaatcgtgactacttgaatcaaagacaaggagcgcttgcaaaaatggaaacaaaagaagctcaggctgtgaggaaacatgccatagatgctggctgcaaccttatcgaccatatagactcaccatcatcaatctgggtctttgcaggagcacccgacagatgccctcctacctgcctgttcattgcaggcatggcagagctaggtgcattctttgctgttctccaggatatgaggaacaccatcatggcgtcaaaaactatcggaacatctgaggagaagctaaagaagaaatcatctttttaccaatcttacctacggaggacacaatctatggggatacaactggaccagcgcatcatcgtgctcttcatggttgactggggaaaagaggcagttgatagttttcatcttggtgatgatatggatcctgagctccggggcctggcacaggcattaattgatcaaaaagtgaaggaaatatctaatcaggaaccgcttaagctttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16691 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (wt)
  source 1..1672: mol_type = other RNA
ggggcgctgcctacggaggtggcagccatctccttctcggcatcaagcttaccatggcaacattagaggaactccaaaaagaaatcaacaaccacgagggccaattggtgatagccaggcagaaggtgaaagatgcagaaaagcagtatgaaaaggatcctgacgacctgaataaaagggcattgagtgaccgggaaagcattgcacaatcaattcagggaaaaatagatgaattaaggagacagctggctgatcgtgtggcagcagggaaaaacattggcaaagagagggacccaactggactagaccctggagatcacctcaaagagaagtcaatgctcagttatggaaatgtcattgacctcaaccatcttgacattgatgaacctacagggcaaaccgcagactggctgagcattgtggtctacctgacatcattcgtggttccaatattgttgaaggctctttacatgcttaccaccagagggagacaaactactaaagacaataagggaatgagaatccgatttaaggatgacagctcttttgaagatgtgaatgggattagaaagccaaagcacctgttcttgtcaatgcccaatgcacaatctagcatgaaggcagatgagattacaccaggtcggttcaggactgcaatttgtggactatacccagcccaggtgaaggcaaggaacttaatcagtcctgtgatgagtgtgattgggtttttagcccttgcaaagaactggacagagcgggttgaggaatggcttgacctcccgtgcaagctactatctgagccatctccaacgtctttgaccaaaggcccatccaccaatcgtgactacttgaatcaaagacaaggagcgcttgcaaaaatggaaacaaaagaagctcaggctgtgaggaaacatgccatagatgctggctgcaaccttatcgaccatatagactcaccatcatcaatctgggtctttgcaggagcacccgacagatgccctcctacctgcctgttcattgcaggcatggcagagctaggtgcattctttgctgttctccaggatatgaggaacaccatcatggcgtcaaaaactatcggaacatctgaggagaagctaaagaagaaatcatctttttaccaatcttacctacggaggacacaatctatggggatacaactggaccagcgcatcatcgtgctgttcatggttgactggggaaaagaggcagttgatagttttcatcttggtgatgatatggatcctgagctccggggcctggcacaggcattaattgatcaaaaagtgaaggaaatatctaatcaggaaccgcttaagctgtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16692 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__GP (wt)
  source 1..3790: mol_type = other RNA
ggggcgctgcctacggaggtggcagccatctccttctcggcatcaagcttaccatgatcatgtggggtttactattgacaatgattttgatcgattttggggcatccttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgactagtttattttcaataatgcctggggtagcacattcaattgcaattgaattatgtgtaccagggttccatggttgggcaactgctgctcttctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacactagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcttcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16693 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__GP (wt)
  source 1..3790: mol_type = other RNA
ggggcgctgcctacggaggtggcagccatctccttctcggcatcaagcttaccatgatcatgtggggtttactattgacaatgattttgatcgattttggggcatccttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgacaagtttattttcaataatgcctggggtagcacattcaattgcaattgaattatgtgtaccagggttccatggttgggcaactgctgctctgctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacacaagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcctcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16694 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (wt)
  source 1..3790: mol_type = other RNA
ggggcgctgcctacggaggtggcagccatctccttctcggcatcaagcttaccatggactggacctggatcctgttcctcgtggccgccgcgacccgcgtccacagcttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgactagtttattttcaataatgcctggggtagcacattcaattgcaattgaattatgtgtaccagggttccatggttgggcaactgctgctcttctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacactagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcttcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16695 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (wt)
  source 1..3790: mol_type = other RNA
ggggcgctgcctacggaggtggcagccatctccttctcggcatcaagcttaccatggactggacctggatcctgttcctcgtggccgccgcgacccgcgtccacagcttaaggaatgtctatgacatgaaaatagaatgcccacattcaatcaactttggggagagtagtgtaacaggtaaggtggagctgccaccccttctgcttacagatgcagaggccttggtcccggaaagttcttgtaacatggacaaccatcagtccatgtcaattatacaaaaagtgacaaaagtaagctggagaaaaaaggcagacaaagcccaagctgccaaggactcatttgagacaacatcaagtgaggttaacttaaagggaacatgtgcattgagtcataggatggttgaagaatcttacagaaataggagatcagtaatatgttatgacttgtcttgcaattcaacacattgcaagccaacgatgcatatgattgtacctgtgcactcatgcaacatgatgaaaagctgcctggttgggcttgggccttatagaatccaaatcgtctatgagagaacctactgtacaactggtatactaacagaagggaagtgttttgtgccagaccagagtattgttaatgttatcaagaatggggtgttcgacatcgcaagtgtgagcattgtctgttttttcatcagagttaaagggaccaactacaagataatggcaagtattaaaacagcaactgcaaataactgtaatgacactgacaacaaggttcaaggatattacctttgtattgtcgggggaaattcttctcctgtgtatgcaccttcaaccactgattttagatctatggaggcacttgctagccttttaagagctcctcatggtgaagaccatgatttatctggagaagaggtggcaacttactcaattgccgggcaaattgaaggcaaaatcccacatactgcaaatgcagcaaacatgctgtttactgcattctcaggaatccctagttactcttcattaagtgtttttatcggaagtcaggacggacctgttatatatagcccaggattgtttcctaggttgaaccaatcttcatgtgataagattgcactaccattaatatgggaaggatatatagatctgcctggctattatgaaacagttcacccatgtaatgtcttttgtgtgttatctggcccaggggcatcatgtgaggcattctcagaaggtggtattttcaacattacatcccctacttgccttgtgtcaaagcaaaataggttcagagctgctgagcagcaagtcaactttgtgtgccagcgagttgaccaagatattgtcatctactgtaatggacaaaagaagacaattttaactaagacattagtgattgggcagtgtatttactcagtgacaagtttattttcaataatgcctggggtagcacattcaattgcaattgaattatgtgtaccagggttccatggttgggcaactgctgctctgctcactacattctgctttggctggatactgatcctttccattacattagctgtgttggttgtcctgaagttttttgccgcaatcttacataatagctctcaagaaaaccggtttaaaattatcttaagaaagattaaagaagaatttgaaaagactaaaggctcaatggtctgtgaagtgtgcaagtatgagtgtgaaacagggaaggagcttaaagcccataatttatcttgccctcagtcacagtgtccttattgctttacacactgtgagcctacagaatctgcctttcaagcacattataaagtgtgccaagcaacacacagatttagggatgatttaaagaaaacaataacacctcaatcaacaagcccaggttgttaccggacattaaatctttttaggtataaaagtagatgttacatctttacagtgtgggtgaccttactaatcattgaatcaatcatgtgggcagctagtgcatcagaaactgtcttggagccaagctggaatgacaatgcacatggtgttggcgttgtcccaatgcatactgacctggaacttgatttctctcttccatcaagttctaagtacacatataagagaaaactgacaagtccattgaatcaagaacaatcagtagatcttcacatagagatagagagtcaagggatctctacaagtgttcatgcattaggtcattggtttgatggaaggcttaacctaaagacatcttttcattgttatggtgcatgtactaagtatgaatacccttggcacacggcaaaatgccactttgaaagagatttcgaatatgagaacaattgggggtgtaatcctgctgattgccctgggattggtactggctgtactgcatgcgggctatacattgaccagcttaaacctgtaggcagtgcatataagctgatcacagtccgttacagccgtaaagtatgtgttcagtttggtgaagaaaatctatgcaagacaattgatatgaatgattgctttgttacaagacatgttaaagtatgtatcatcggtacagtttcaaagttctcgcaaggtgataccctagtattcctaggccctatggaaggtgggggtttgatatttaaggattggtgcactagcacatgccaatttggtgatccaggagacattatgagtcctaaagacaaaggtttcagctgccctgacttcacaggccatttccggaaaaaatgcaactttgcaacaacacctgtgtgcgagtatgatggtaatatggtctctgggtataagaaagtaatggcaactattgattcctttcaatcatttaacacaagttcaattcattatacagatgaaaggattgagtggaaagacccggatggaatgcttaaggaccaccttaatatacttgtcacaaaggatattgactttgaaaaccttggagagaacccgtgtaaagtaggacttcaaacatcatcaatagaaggtgcatggggttctggggttggtttcactctcacttgtcaaatctcactgacagagtgttcacgctttctaacatcaatcaaagcatgtgacatggcaatttgttatggtgcacaaagtgttacactcattagaggccaaaacacagtgaaggtttccgggaagggtgggcatagtggctcctcattcaagtgttgccatggaacagattgctctcaacaggggctacaagcaagtgcaccgcacctggataaggtcaatgggattgttgaacaagagagtgagaaggtttatgatgatggtgcaccacaatgtggcatttcatgctggtttgttaagtctggggagtggataacaggaattttcaatgggaattggattgtcatagttgtgcttgttttcttcttcatattgtccttaatcttacttagtcttctatgtcccattcgtaagcataaacgctcataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16696 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (opt4)
  source 1..1672: mol_type = other RNA
ggggcgctgcctacggaggtggcagccatctccttctcggcatcaagcttaccatggccaccctggaggagctgcagaaggagatcaacaaccacgagggccagctggtgatcgccagacagaaggtgaaggacgccgagaagcagtacgagaaggaccccgacgacctgaacaagagagccctgagcgacagagagagcatcgcccagagcatccagggcaagatcgacgagctgagaagacagctggccgacagagtggccgccggcaagaacatcggcaaggagagagaccccaccggcctggaccccggcgaccacctgaaggagaagagcatgctgagctacggcaacgtgatcgacctgaaccacctggacatcgacgagcccaccggccagaccgccgactggctgagcatcgtggtgtacctgaccagcttcgtggtgcccatcctgctgaaggccctgtacatgctgaccaccagaggcagacagaccaccaaggacaacaagggcatgagaatcagattcaaggacgacagcagcttcgaggacgtgaacggcatcagaaagcccaagcacctgttcctgagcatgcccaacgcccagagcagcatgaaggccgacgagatcacccccggcagattcagaaccgccatctgcggcctgtaccccgcccaggtgaaggccagaaacctgatcagccccgtgatgagcgtgatcggcttcctggccctggccaagaactggaccgagagagtggaggagtggctggacctgccctgcaagctgctgagcgagcccagccccaccagcctgaccaagggccccagcaccaacagagactacctgaaccagagacagggcgccctggccaagatggagaccaaggaggcccaggccgtgagaaagcacgccatcgacgccggctgcaacctgatcgaccacatcgacagccccagcagcatctgggtgttcgccggcgcccccgacagatgcccccccacctgcctgttcatcgccggcatggccgagctgggcgccttcttcgccgtgctgcaggacatgagaaacaccatcatggccagcaagaccatcggcaccagcgaggagaagctgaagaagaagagcagcttctaccagagctacctgagaagaacccagagcatgggcatccagctggaccagagaatcatcgtgctgttcatggtggactggggcaaggaggccgtggacagcttccacctgggcgacgacatggaccccgagctgagaggcctggcccaggccctgatcgaccagaaggtgaaggagatcagcaaccaggagcccctgaagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16697 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__GP (opt4)
  source 1..3790: mol_type = other RNA
ggggcgctgcctacggaggtggcagccatctccttctcggcatcaagcttaccatgatcatgtggggcctgctgctgaccatgatcctgatcgacttcggcgccagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcgccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccagatcgtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccgtgatctacagccccggcctgttccccagactgaaccagagcagctgcgacaagatcgccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatcctgagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16698 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (opt4)
  source 1..3790: mol_type = other RNA
ggggcgctgcctacggaggtggcagccatctccttctcggcatcaagcttaccatggactggacctggatcctgttcctggtggccgccgccaccagagtgcacagcctgagaaacgtgtacgacatgaagatcgagtgcccccacagcatcaacttcggcgagagcagcgtgaccggcaaggtggagctgccccccctgctgctgaccgacgccgaggccctggtgcccgagagcagctgcaacatggacaaccaccagagcatgagcatcatccagaaggtgaccaaggtgagctggagaaagaaggccgacaaggcccaggccgccaaggacagcttcgagaccaccagcagcgaggtgaacctgaagggcacctgcgccctgagccacagaatggtggaggagagctacagaaacagaagaagcgtgatctgctacgacctgagctgcaacagcacccactgcaagcccaccatgcacatgatcgtgcccgtgcacagctgcaacatgatgaagagctgcctggtgggcctgggcccctacagaatccagatcgtgtacgagagaacctactgcaccaccggcatcctgaccgagggcaagtgcttcgtgcccgaccagagcatcgtgaacgtgatcaagaacggcgtgttcgacatcgccagcgtgagcatcgtgtgcttcttcatcagagtgaagggcaccaactacaagatcatggccagcatcaagaccgccaccgccaacaactgcaacgacaccgacaacaaggtgcagggctactacctgtgcatcgtgggcggcaacagcagccccgtgtacgcccccagcaccaccgacttcagaagcatggaggccctggccagcctgctgagagccccccacggcgaggaccacgacctgagcggcgaggaggtggccacctacagcatcgccggccagatcgagggcaagatcccccacaccgccaacgccgccaacatgctgttcaccgccttcagcggcatccccagctacagcagcctgagcgtgttcatcggcagccaggacggccccgtgatctacagccccggcctgttccccagactgaaccagagcagctgcgacaagatcgccctgcccctgatctgggagggctacatcgacctgcccggctactacgagaccgtgcacccctgcaacgtgttctgcgtgctgagcggccccggcgccagctgcgaggccttcagcgagggcggcatcttcaacatcaccagccccacctgcctggtgagcaagcagaacagattcagagccgccgagcagcaggtgaacttcgtgtgccagagagtggaccaggacatcgtgatctactgcaacggccagaagaagaccatcctgaccaagaccctggtgatcggccagtgcatctacagcgtgaccagcctgttcagcatcatgcccggcgtggcccacagcatcgccatcgagctgtgcgtgcccggcttccacggctgggccaccgccgccctgctgaccaccttctgcttcggctggatcctgatcctgagcatcaccctggccgtgctggtggtgctgaagttcttcgccgccatcctgcacaacagcagccaggagaacagattcaagatcatcctgagaaagatcaaggaggagttcgagaagaccaagggcagcatggtgtgcgaggtgtgcaagtacgagtgcgagaccggcaaggagctgaaggcccacaacctgagctgcccccagagccagtgcccctactgcttcacccactgcgagcccaccgagagcgccttccaggcccactacaaggtgtgccaggccacccacagattcagagacgacctgaagaagaccatcaccccccagagcaccagccccggctgctacagaaccctgaacctgttcagatacaagagcagatgctacatcttcaccgtgtgggtgaccctgctgatcatcgagagcatcatgtgggccgccagcgccagcgagaccgtgctggagcccagctggaacgacaacgcccacggcgtgggcgtggtgcccatgcacaccgacctggagctggacttcagcctgcccagcagcagcaagtacacctacaagagaaagctgaccagccccctgaaccaggagcagagcgtggacctgcacatcgagatcgagagccagggcatcagcaccagcgtgcacgccctgggccactggttcgacggcagactgaacctgaagaccagcttccactgctacggcgcctgcaccaagtacgagtacccctggcacaccgccaagtgccacttcgagagagacttcgagtacgagaacaactggggctgcaaccccgccgactgccccggcatcggcaccggctgcaccgcctgcggcctgtacatcgaccagctgaagcccgtgggcagcgcctacaagctgatcaccgtgagatacagcagaaaggtgtgcgtgcagttcggcgaggagaacctgtgcaagaccatcgacatgaacgactgcttcgtgaccagacacgtgaaggtgtgcatcatcggcaccgtgagcaagttcagccagggcgacaccctggtgttcctgggccccatggagggcggcggcctgatcttcaaggactggtgcaccagcacctgccagttcggcgaccccggcgacatcatgagccccaaggacaagggcttcagctgccccgacttcaccggccacttcagaaagaagtgcaacttcgccaccacccccgtgtgcgagtacgacggcaacatggtgagcggctacaagaaggtgatggccaccatcgacagcttccagagcttcaacaccagcagcatccactacaccgacgagagaatcgagtggaaggaccccgacggcatgctgaaggaccacctgaacatcctggtgaccaaggacatcgacttcgagaacctgggcgagaacccctgcaaggtgggcctgcagaccagcagcatcgagggcgcctggggcagcggcgtgggcttcaccctgacctgccagatcagcctgaccgagtgcagcagattcctgaccagcatcaaggcctgcgacatggccatctgctacggcgcccagagcgtgaccctgatcagaggccagaacaccgtgaaggtgagcggcaagggcggccacagcggcagcagcttcaagtgctgccacggcaccgactgcagccagcagggcctgcaggccagcgccccccacctggacaaggtgaacggcatcgtggagcaggagagcgagaaggtgtacgacgacggcgccccccagtgcggcatcagctgctggttcgtgaagagcggcgagtggatcaccggcatcttcaacggcaactggatcgtgatcgtggtgctggtgttcttcttcatcctgagcctgatcctgctgagcctgctgtgccccatcagaaagcacaagagaagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16699 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (opt3)
  source 1..1672: mol_type = other RNA
ggggcgctgcctacggaggtggcagccatctccttctcggcatcaagcttaccatggccaccctggaggaactccagaaggagatcaacaatcacgaaggccaacttgtgattgctagacagaaagtcaaggacgcagagaaacagtacgaaaaggatcccgacgatctgaacaaaagggccttgagcgaccgggagtccatagcgcagtctatccaagggaagattgatgagttacgccgacagctggctgaccgtgttgccgcaggaaagaatatcggtaaagaaagagatcctacaggcctagacccaggggatcatctcaaggagaaatcaatgctgagttatggaaacgtgattgaccttaatcacctggatatcgacgaaccgactggccagacggccgattggttgagcatagtagtgtacctcacctccttcgtcgtgcccatcctgctgaaggctctctatatgttaacaactaggggtcggcagaccacaaaagacaacaaggggatgcgcattagatttaaggacgattcttcgttcgaggacgttaatggaatcaggaaacctaagcatctgtttctttcaatgccaaacgcacaaagcagtatgaaagccgatgagattacccccggccggttccgcactgctatctgcggcttgtaccctgcccaggtgaaggcgcgaaatctgatatccccagtcatgtctgtgattgggtttctagcactcgccaaaaactggacagaaagagtagaggaatggctggaccttccctgtaagctgttgagcgagccttccccaacctcactcacgaaaggaccgagtactaatagggattatctgaaccagcggcagggtgctttagccaagatggaaaccaaggaggcacaagctgttcgtaaacacgccatcgacgcgggctgcaatctgattgatcatatcgacagcccctcttccatctgggtgttcgccggggcacctgatcgctgtccacccacatgcctctttattgctggaatggccgagcttggcgctttctttgccgtcctgcaggacatgagaaacactataatggcatcaaagaccatcggtacaagcgaagagaaattgaagaaaaagagttctttctaccagtcctatctaaggcggacccaaagcatggggattcagctggatcagcgaatcatagtgctctttatggtggactggggaaaggaagccgtcgactcgttccacctgggcgatgacatggatcctgagcttcgcggcctggctcaggcgttgattgaccaaaaagttaaggaaatctctaatcaggagccactcaaactgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16700 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__GP (opt3)
  source 1..3790: mol_type = other RNA
ggggcgctgcctacggaggtggcagccatctccttctcggcatcaagcttaccatgatcatgtggggcctgctccttaccatgattctgatagacttcggggccagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcgcactgtcccaccggatggtggaggaatcttatcgcaatcgacgtagcgttatctgttacgacttgtcctgcaactcaacccattgtaagcccacaatgcacatgatagtgcctgtccatagttgcaatatgatgaaaagctgtctcgtggggctgggaccatatagaatccagattgtatacgagaggacctattgcactacaggcatcctgaccgaaggtaagtgttttgttcccgatcagtctattgtgaacgtcatcaaaaatggggtgttcgacatagcctccgtgtcaattgtctgctttttcatccgggttaagggaacgaactacaagattatggctagcatcaaaactgcaaccgccaataactgtaatgatacagacaacaaggtgcaaggctattacctctgcatcgtaggcgggaatagttctcctgtgtacgctccatccactaccgattttcgcagcatggaggccttagcgtcgctgcttagagcaccccacggagaggaccacgatttgtctggtgaagaggtcgccacatattccattgctggccagatagaagggaaaatccctcataccgccaacgcagctaacatgctgttcacggccttttcagggattccaagttacagctccctatctgtgttcatcggcagccaggacggtccggttatatattcacccgggctctttcctaggctgaatcagagttcctgcgacaagattgcgcttccactgatctgggagggatacatcgatttgcccggctattacgaaactgtgcacccttgtaacgtcttctgcgtgctcagcggcccaggggcctcttgtgaggcattttcagagggaggtattttcaatatcacaagtccgacctgcctggtaagcaaacaaaaccggttccgcgctgccgaacagcaggttaattttgtgtgtcagcgagtcgaccaagatattgtgatatattgcaacggccagaagaaaactatcttaacaaagaccctggtcattgggcagtgtatctactccgtgacgtctctcttctcgatcatgcccggagttgctcatagcattgccatagagctttgcgtgcctggctttcacggttgggcaaccgccgctctgttgacaactttctgttttgggtggatcctaattctgtccatcaccctcgcggtactggtcgtgcttaagttctttgcagccattctgcacaattcaagtcaagaaaacagattcaaaatcatattgaggaagatcaaagaggaatttgagaagacaaaaggctctatggtttgcgaggtgtgtaagtacgaatgcgagactggaaaggaactcaaagctcataatctgagctgcccccagtcccagtgtccatattgcttcacccactgtgagcctacagaatcagcctttcaggcacattacaaggtctgccaagccacccaccggttccgtgacgatctgaaaaagactattacgccccagagcacatctccaggctgttatcgcaccttaaacctatttagatacaaatccaggtgctatatcttcactgtgtgggtaaccctcctgattatcgagagtataatgtgggctgccagcgcatctgagacagtgcttgaaccctcctggaatgacaacgcgcatggggttggagtcgtgcctatgcacaccgatttggagctggacttctcactcccaagtagctcgaagtacacttataagcggaaactgacatccccgcttaatcaggaacagtctgtggatctgcacattgagatcgagagccaaggtatttcaacgagtgtccatgctttgggccactggtttgacgggcgactcaacctgaagacctccttccattgttacggagcctgcactaaatacgaatatccctggcacacagcaaagtgtcactttgagcgcgatttcgaatacgagaataactggggctgcaaccctgccgactgtccaggtatcgggaccggctgcacagcttgcggattatatatagaccagctgaaacccgttggctctgcctacaagctaatcactgtgagatatagcaggaaggtgtgtgtacagtttggggaagagaatctctgcaaaaccattgatatgaacgactgtttcgtcacgcggcatgtgaaggtttgcatcattggaaccgtgtccaaattttcacagggtgatacactggtcttccttggccctatggagggaggaggcttgatctttaaggactggtgtactagcacatgccaattcggtgatccaggggacataatgagtcccaaagataagggcttttcttgtccggacttcaccggacactttcgcaaaaagtgcaatttcgcaactacccctgtgtgtgaatacgatggcaacatggtttccgggtataagaaagtgatggctacgattgacagcttccagtcgtttaatacatcatctatccattacaccgatgagagaatcgaatggaaggacccagatggaatgctgaaagaccacctcaacattctggtaactaaggacatcgatttcgagaatttaggcgaaaacccctgcaaagtcggtctgcagacaagttccattgagggggcctggggaagcggcgtgggttttacccttacttgtcagatatctttgaccgagtgcagcaggttcctcacatccatcaaggcgtgcgacatggccatttgttacggcgctcaatcagtgacgctgatccgtgggcagaataccgtcaaggttagtggaaaaggcgggcatagcggatcttcctttaagtgctgtcacggcactgattgctcacagcaaggtctacaggcaagtgcccctcacctggacaaagtgaacgggattgtagaacaggagagcgaaaaggtgtatgatgacggagctccccagtgtggcatctcctgctggttcgtcaaatctggtgagtggataacaggcatctttaatgggaactggattgtgatcgttgtgctcgtcttctttttcattctgtcgcttatcttgctgagcttactctgtccaatacggaagcataagcgatcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16701 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (opt3)
  source 1..3790: mol_type = other RNA
ggggcgctgcctacggaggtggcagccatctccttctcggcatcaagcttaccatggactggacctggatcctgttcctcgtggccgctgcaacaagagtccacagcttgagaaacgtgtacgatatgaagatcgagtgcccccactccattaattttggagaatcttcagtcacaggtaaagttgagttacctccactgctactcactgacgctgaagcactggtgccggagagtagctgtaacatggataatcatcagtccatgtctatcattcaaaaggtaacgaaagtgtcgtggaggaagaaagccgacaaggcgcaggctgccaaggattcattcgaaaccacaagcagtgaggtcaaccttaaaggcacttgcgcactgtcccaccggatggtggaggaatcttatcgcaatcgacgtagcgttatctgttacgacttgtcctgcaactcaacccattgtaagcccacaatgcacatgatagtgcctgtccatagttgcaatatgatgaaaagctgtctcgtggggctgggaccatatagaatccagattgtatacgagaggacctattgcactacaggcatcctgaccgaaggtaagtgttttgttcccgatcagtctattgtgaacgtcatcaaaaatggggtgttcgacatagcctccgtgtcaattgtctgctttttcatccgggttaagggaacgaactacaagattatggctagcatcaaaactgcaaccgccaataactgtaatgatacagacaacaaggtgcaaggctattacctctgcatcgtaggcgggaatagttctcctgtgtacgctccatccactaccgattttcgcagcatggaggccttagcgtcgctgcttagagcaccccacggagaggaccacgatttgtctggtgaagaggtcgccacatattccattgctggccagatagaagggaaaatccctcataccgccaacgcagctaacatgctgttcacggccttttcagggattccaagttacagctccctatctgtgttcatcggcagccaggacggtccggttatatattcacccgggctctttcctaggctgaatcagagttcctgcgacaagattgcgcttccactgatctgggagggatacatcgatttgcccggctattacgaaactgtgcacccttgtaacgtcttctgcgtgctcagcggcccaggggcctcttgtgaggcattttcagagggaggtattttcaatatcacaagtccgacctgcctggtaagcaaacaaaaccggttccgcgctgccgaacagcaggttaattttgtgtgtcagcgagtcgaccaagatattgtgatatattgcaacggccagaagaaaactatcttaacaaagaccctggtcattgggcagtgtatctactccgtgacgtctctcttctcgatcatgcccggagttgctcatagcattgccatagagctttgcgtgcctggctttcacggttgggcaaccgccgctctgttgacaactttctgttttgggtggatcctaattctgtccatcaccctcgcggtactggtcgtgcttaagttctttgcagccattctgcacaattcaagtcaagaaaacagattcaaaatcatattgaggaagatcaaagaggaatttgagaagacaaaaggctctatggtttgcgaggtgtgtaagtacgaatgcgagactggaaaggaactcaaagctcataatctgagctgcccccagtcccagtgtccatattgcttcacccactgtgagcctacagaatcagcctttcaggcacattacaaggtctgccaagccacccaccggttccgtgacgatctgaaaaagactattacgccccagagcacatctccaggctgttatcgcaccttaaacctatttagatacaaatccaggtgctatatcttcactgtgtgggtaaccctcctgattatcgagagtataatgtgggctgccagcgcatctgagacagtgcttgaaccctcctggaatgacaacgcgcatggggttggagtcgtgcctatgcacaccgatttggagctggacttctcactcccaagtagctcgaagtacacttataagcggaaactgacatccccgcttaatcaggaacagtctgtggatctgcacattgagatcgagagccaaggtatttcaacgagtgtccatgctttgggccactggtttgacgggcgactcaacctgaagacctccttccattgttacggagcctgcactaaatacgaatatccctggcacacagcaaagtgtcactttgagcgcgatttcgaatacgagaataactggggctgcaaccctgccgactgtccaggtatcgggaccggctgcacagcttgcggattatatatagaccagctgaaacccgttggctctgcctacaagctaatcactgtgagatatagcaggaaggtgtgtgtacagtttggggaagagaatctctgcaaaaccattgatatgaacgactgtttcgtcacgcggcatgtgaaggtttgcatcattggaaccgtgtccaaattttcacagggtgatacactggtcttccttggccctatggagggaggaggcttgatctttaaggactggtgtactagcacatgccaattcggtgatccaggggacataatgagtcccaaagataagggcttttcttgtccggacttcaccggacactttcgcaaaaagtgcaatttcgcaactacccctgtgtgtgaatacgatggcaacatggtttccgggtataagaaagtgatggctacgattgacagcttccagtcgtttaatacatcatctatccattacaccgatgagagaatcgaatggaaggacccagatggaatgctgaaagaccacctcaacattctggtaactaaggacatcgatttcgagaatttaggcgaaaacccctgcaaagtcggtctgcagacaagttccattgagggggcctggggaagcggcgtgggttttacccttacttgtcagatatctttgaccgagtgcagcaggttcctcacatccatcaaggcgtgcgacatggccatttgttacggcgctcaatcagtgacgctgatccgtgggcagaataccgtcaaggttagtggaaaaggcgggcatagcggatcttcctttaagtgctgtcacggcactgattgctcacagcaaggtctacaggcaagtgcccctcacctggacaaagtgaacgggattgtagaacaggagagcgaaaaggtgtatgatgacggagctccccagtgtggcatctcctgctggttcgtcaaatctggtgagtggataacaggcatctttaatgggaactggattgtgatcgttgtgctcgtcttctttttcattctgtcgcttatcttgctgagcttactctgtccaatacggaagcataagcgatcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16702 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (opt1)
  source 1..1672: mol_type = other RNA
ggggcgctgcctacggaggtggcagccatctccttctcggcatcaagcttaccatggccaccctggaggagctccagaaggagatcaacaaccacgagggccagctggtgatcgcccgccagaaggtcaaggacgcggagaagcagtacgagaaggaccccgacgacctgaacaagcgggccctcagcgaccgcgagtccatcgcccagagcatccaggggaagatcgacgagctgcggcgccagctggccgaccgggtggccgcgggcaagaacatcgggaaggagcgcgaccccaccggcctcgaccccggggaccacctgaaggagaagtccatgctgagctacggcaacgtgatcgacctcaaccacctggacatcgacgagcccacgggccagaccgccgactggctgtccatcgtcgtgtacctcaccagcttcgtggtccccatcctgctgaaggccctctacatgctgaccacgcgggggcgccagaccaccaaggacaacaagggcatgcggatccgcttcaaggacgactccagcttcgaggacgtgaacgggatccggaagccgaagcacctgttcctctccatgcccaacgcccagagctccatgaaggcggacgagatcacccccggccgcttccggacggccatctgcgggctgtaccccgcccaggtgaaggcccgcaacctgatcagcccggtcatgtccgtgatcggcttcctcgccctggcgaagaactggaccgagcgggtggaggagtggctggacctcccctgcaagctgctgagcgagccctcccccaccagcctcaccaagggcccgtccacgaaccgcgactacctgaaccagcggcagggggccctggccaagatggagaccaaggaggcccaggccgtccgcaagcacgcgatcgacgccggctgcaacctcatcgaccacatcgacagcccctccagcatctgggtgttcgccggggcccccgaccggtgcccgccgacctgcctgttcatcgccggcatggcggagctgggcgccttcttcgccgtgctccaggacatgcgcaacaccatcatggccagcaagacgatcgggacctccgaggagaagctgaagaagaagtccagcttctaccagagctacctgcggcgcacccagtccatgggcatccagctcgaccagcgcatcatcgtcctgttcatggtggactgggggaaggaggccgtggacagcttccacctgggcgacgacatggaccccgagctccgggggctggcgcaggccctgatcgaccagaaggtcaaggagatctccaaccaggagcccctcaagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16703 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__GP (opt1)
  source 1..3790: mol_type = other RNA
ggggcgctgcctacggaggtggcagccatctccttctcggcatcaagcttaccatgatcatgtggggcctgctcctgaccatgatcctgatcgacttcggggccagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16704 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (opt1)
  source 1..3790: mol_type = other RNA
ggggcgctgcctacggaggtggcagccatctccttctcggcatcaagcttaccatggactggacctggatcctgttcctcgtggccgccgcgacccgcgtccacagcctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16705 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (opt5)
  source 1..1672: mol_type = other RNA
ggggcgctgcctacggaggtggcagccatctccttctcggcatcaagcttaccatggccaccctggaggaactccagaaggagatcaacaatcacgaaggccaactggtgattgctagacagaaagtcaaggacgccgagaaacagtacgaaaaggatcccgacgatcttaacaaacgggcgctgagcgaccgcgagtccatcgctcagtctattcaagggaagatcgatgagctcagacggcagctggccgaccgcgttgccgctggaaagaatattggcaaagaaagagatcctacagggcttgacccgggagatcatctgaaggagaaaagcatgctctcctatggcaacgtgatcgacctgaatcacctggatatcgacgaacccacggggcagaccgccgattggctctctattgtggtctacctgaccagcttcgtggttcctatccttctgaaggctctctatatgctgacaacacggggacgccagaccacaaaagacaacaagggcatgcggattagatttaaggacgattcctctttcgaggacgtgaatggcatccgcaaacccaagcatctttttctgagcatgcctaacgcccaatccagcatgaaagcggatgagattacccccgggagattccggacggccatctgcggactctaccctgctcaggtcaaggcccgcaatctgatttctccggtgatgtccgttatcggctttctggctctcgccaaaaactggaccgaaagagtggaggaatggctggaccttccctgtaagctgctcagcgagccttctcccacatccctgaccaaagggcctagcacaaatcgggattatcttaaccagcgccagggagcgctggccaagatggaaaccaaggaggctcaagccgtcagaaaacacgctatcgacgccggctgcaatctcattgatcatatcgactctccctccagcatttgggtgttcgccggggctccggatcggtgtcctcccacgtgcctgtttatcgcgggaatggccgagctgggcgctttctttgccgtgctccaggacatgagaaacacaattatggcctccaagaccatcggcacatctgaagagaaactgaagaaaaagagctccttctaccagagctatcttcgccggacccaatctatggggatccagctggatcagagaattatcgtcctctttatggttgactggggaaaggaagctgtggactccttccacctgggcgatgacatggatcctgagcttcgcgggctggcccaggcgctcattgaccaaaaagtgaaggaaatcagcaatcaggagcccctgaaactgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16706 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__GP (opt5)
  source 1..3790: mol_type = other RNA
ggggcgctgcctacggaggtggcagccatctccttctcggcatcaagcttaccatgatcatgtggggcctgctcctgaccatgattcttatcgacttcggggccagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcgctctgtctcaccgcatggttgaggaatcctatagaaatcggcgcagcgtgatctgttacgacctctcttgcaactccacccattgtaagcctacaatgcacatgattgtccccgtgcatagctgcaatatgatgaaatcttgtctggttggacttggcccttatagaatccagattgtgtacgagcggacctattgcacgaccgggatcctgacagaaggaaagtgttttgtccccgatcagtccattgtgaacgtgatcaaaaatggcgtcttcgacattgccagcgtttccatcgtgtgctttttcatccgcgtgaagggcaccaactacaagattatggcttctatcaaaacagccaccgcgaataactgtaatgatacggacaacaaggtccaagggtattacctctgcattgtgggaggcaatagctcccctgtttacgccccgagcacaaccgattttagatctatggaggctctggcctcccttctgcgggctccccacggggaggaccacgatctcagcggagaagaggtggccacatattctatcgcgggccagattgaagggaaaatccctcataccgccaacgctgccaacatgctgttcaccgcttttagcggaatcccctcctactctagcctgtccgtcttcattggcagccaggacggccctgtgatctattctcccgggctctttccgcgcctgaatcagtccagctgcgacaagattgcccttcctctgatctgggagggatacattgatctccccggctattacgaaacagttcacccttgtaacgtgttctgcgtcctgtctgggcccggagcctcctgtgaggcttttagcgagggcgggatcttcaatatcacgtcccccacatgccttgtgtctaaacaaaacagattccgggcggccgaacagcaggtcaattttgtgtgtcagcgcgttgaccaagatattgtgatctattgcaacggacagaagaaaacaattctgaccaagacactcgtcatcggccagtgtatttacagcgtgacctccctgttctctatcatgcctggcgttgctcatagcattgccatcgagctgtgcgtgccggggtttcacggatgggccacggctgccctcctgacaaccttctgttttggctggatccttattctgtccatcaccctcgcggtcctggtggtgcttaagttctttgctgccattctgcacaatagctctcaagaaaacagattcaaaatcattctccggaagatcaaagaggaatttgagaagacaaaagggtccatggtttgcgaggtctgtaagtacgaatgcgagaccggaaaggaactgaaagcccataatctgagctgcccccagtctcagtgtccttattgcttcacacactgtgagcccacggaatccgcttttcaggcccattacaaggtgtgccaagctacccaccgcttcagagacgatctcaaaaagacaatcacccctcagagcacatctcccggctgttatcggaccctgaacctttttagatacaaaagccgctgctatattttcacggtgtgggtcaccctgctcatcattgagtccatcatgtgggccgcgagcgcctctgagacagtgctggaaccgtcctggaatgacaacgctcatggggttggcgtggtccctatgcacaccgatctggagcttgacttcagcctcccctcctctagcaagtacacatataagcggaaactgacctcccctctgaatcaggaacagtctgtggatctccacattgagatcgagagccaaggaatctccacgtctgttcatgccctgggccactggtttgacgggagacttaacctgaagaccagcttccattgttacggagcttgcaccaaatacgaatatccctggcacacagccaagtgtcactttgagcgcgatttcgaatacgagaataactggggctgcaaccctgcggactgtcccgggattggaaccggctgcaccgcctgcgggctctatatcgaccagctgaaaccggtgggctccgcttacaagctgattacagtccggtatagcagaaaggtgtgtgttcagtttggagaagagaatctttgcaaaacgatcgatatgaacgactgtttcgtgacccgccatgtcaaggtgtgcattatcggcacagtgtctaaattttcccagggggataccctcgtcttcctgggacctatggagggcgggggactgatctttaaggactggtgtacatctacctgccaattcggcgatcccggggacattatgagccccaaagataagggcttttcctgtcctgacttcacgggacactttcggaaaaagtgcaatttcgccacaaccccggtttgtgaatacgatggcaacatggtgagcgggtataagaaagtgatggctaccatcgactctttccagtcctttaatacaagctccattcattacaccgatgagagaatcgaatggaaggaccccgatggaatgctcaaagaccacctgaacattcttgtcacaaaggacatcgatttcgagaatctgggcgaaaacccttgcaaagtggggctccagacgagctctattgagggagcctggggcagcggggttggctttaccctgacatgtcagatctccctgaccgagtgctctcgcttccttacaagcatcaaggcctgcgacatggctatttgttacggagcgcaatccgtgaccctcatccggggccagaatacggtcaaggtgtctgggaaaggaggccatagcgggtcctcttttaagtgctgtcacggaaccgattgcagccagcaaggcctgcaggcctccgctccccacctggacaaagttaacggcattgtggaacaggagagcgaaaaggtctatgatgacggggcccctcagtgtggaatctcttgctggttcgtgaaatccggcgagtggattacagggatctttaatggaaactggatcgttattgtggtcctcgtgttctttttcatcctgagccttattctgctctctctgctgtgtcccatcagaaagcataagcgctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16707 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (opt5)
  source 1..3790: mol_type = other RNA
ggggcgctgcctacggaggtggcagccatctccttctcggcatcaagcttaccatggactggacctggatcctgttcctcgtggccgctgccacaagagtccacagcctgagaaacgtgtacgatatgaagattgagtgcccccactccatcaattttggagaatctagcgtcacaggcaaagttgagctccctccgctgcttctgacggacgctgaagccctcgtgcccgagtcctcttgtaacatggataatcatcagagcatgtccattatccaaaaggtgaccaaagtctcttggcggaagaaagcggacaaggctcaggccgccaaggatagcttcgaaacaacctccagcgaggtgaacctgaaagggacatgcgctctgtctcaccgcatggttgaggaatcctatagaaatcggcgcagcgtgatctgttacgacctctcttgcaactccacccattgtaagcctacaatgcacatgattgtccccgtgcatagctgcaatatgatgaaatcttgtctggttggacttggcccttatagaatccagattgtgtacgagcggacctattgcacgaccgggatcctgacagaaggaaagtgttttgtccccgatcagtccattgtgaacgtgatcaaaaatggcgtcttcgacattgccagcgtttccatcgtgtgctttttcatccgcgtgaagggcaccaactacaagattatggcttctatcaaaacagccaccgcgaataactgtaatgatacggacaacaaggtccaagggtattacctctgcattgtgggaggcaatagctcccctgtttacgccccgagcacaaccgattttagatctatggaggctctggcctcccttctgcgggctccccacggggaggaccacgatctcagcggagaagaggtggccacatattctatcgcgggccagattgaagggaaaatccctcataccgccaacgctgccaacatgctgttcaccgcttttagcggaatcccctcctactctagcctgtccgtcttcattggcagccaggacggccctgtgatctattctcccgggctctttccgcgcctgaatcagtccagctgcgacaagattgcccttcctctgatctgggagggatacattgatctccccggctattacgaaacagttcacccttgtaacgtgttctgcgtcctgtctgggcccggagcctcctgtgaggcttttagcgagggcgggatcttcaatatcacgtcccccacatgccttgtgtctaaacaaaacagattccgggcggccgaacagcaggtcaattttgtgtgtcagcgcgttgaccaagatattgtgatctattgcaacggacagaagaaaacaattctgaccaagacactcgtcatcggccagtgtatttacagcgtgacctccctgttctctatcatgcctggcgttgctcatagcattgccatcgagctgtgcgtgccggggtttcacggatgggccacggctgccctcctgacaaccttctgttttggctggatccttattctgtccatcaccctcgcggtcctggtggtgcttaagttctttgctgccattctgcacaatagctctcaagaaaacagattcaaaatcattctccggaagatcaaagaggaatttgagaagacaaaagggtccatggtttgcgaggtctgtaagtacgaatgcgagaccggaaaggaactgaaagcccataatctgagctgcccccagtctcagtgtccttattgcttcacacactgtgagcccacggaatccgcttttcaggcccattacaaggtgtgccaagctacccaccgcttcagagacgatctcaaaaagacaatcacccctcagagcacatctcccggctgttatcggaccctgaacctttttagatacaaaagccgctgctatattttcacggtgtgggtcaccctgctcatcattgagtccatcatgtgggccgcgagcgcctctgagacagtgctggaaccgtcctggaatgacaacgctcatggggttggcgtggtccctatgcacaccgatctggagcttgacttcagcctcccctcctctagcaagtacacatataagcggaaactgacctcccctctgaatcaggaacagtctgtggatctccacattgagatcgagagccaaggaatctccacgtctgttcatgccctgggccactggtttgacgggagacttaacctgaagaccagcttccattgttacggagcttgcaccaaatacgaatatccctggcacacagccaagtgtcactttgagcgcgatttcgaatacgagaataactggggctgcaaccctgcggactgtcccgggattggaaccggctgcaccgcctgcgggctctatatcgaccagctgaaaccggtgggctccgcttacaagctgattacagtccggtatagcagaaaggtgtgtgttcagtttggagaagagaatctttgcaaaacgatcgatatgaacgactgtttcgtgacccgccatgtcaaggtgtgcattatcggcacagtgtctaaattttcccagggggataccctcgtcttcctgggacctatggagggcgggggactgatctttaaggactggtgtacatctacctgccaattcggcgatcccggggacattatgagccccaaagataagggcttttcctgtcctgacttcacgggacactttcggaaaaagtgcaatttcgccacaaccccggtttgtgaatacgatggcaacatggtgagcgggtataagaaagtgatggctaccatcgactctttccagtcctttaatacaagctccattcattacaccgatgagagaatcgaatggaaggaccccgatggaatgctcaaagaccacctgaacattcttgtcacaaaggacatcgatttcgagaatctgggcgaaaacccttgcaaagtggggctccagacgagctctattgagggagcctggggcagcggggttggctttaccctgacatgtcagatctccctgaccgagtgctctcgcttccttacaagcatcaaggcctgcgacatggctatttgttacggagcgcaatccgtgaccctcatccggggccagaatacggtcaaggtgtctgggaaaggaggccatagcgggtcctcttttaagtgctgtcacggaaccgattgcagccagcaaggcctgcaggcctccgctccccacctggacaaagttaacggcattgtggaacaggagagcgaaaaggtctatgatgacggggcccctcagtgtggaatctcttgctggttcgtgaaatccggcgagtggattacagggatctttaatggaaactggatcgttattgtggtcctcgtgttctttttcatcctgagccttattctgctctctctgctgtgtcccatcagaaagcataagcgctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16708 - RNA, 1672 nt, synthetic construct
  misc_feature 1..1672: note = mRNA product Design2 comprising derived and/or modified sequence from DOBV(DOBV/Ano-Poroia/Afl9/1999)__NC_005233.1__N (opt11)
  source 1..1672: mol_type = other RNA
ggggcgctgcctacggaggtggcagccatctccttctcggcatcaagcttaccatggccaccctagaagaactccaaaaagaaatcaacaaccacgaaggacaactcgtaatcgcacgccaaaaagtcaaagacgccgaaaaacaatacgaaaaagaccccgacgatcttaacaaacgagcactctcagaccgcgaaagcatcgcccaaagcatccaaggaaaaatagacgaactccgccgtcaactcgcagaccgagtcgcagcaggcaaaaacatcggaaaagaacgcgaccctaccggccttgacccaggcgaccacctgaaagaaaaatcaatgctaagctacggcaacgtcatcgaccttaaccacctagacattgacgagccaacaggccaaaccgccgactggctatccatcgtcgtatacctgacctcattcgtagtccccatcctcctaaaagccctctacatgctcaccacccgcggcagacaaacaaccaaagacaacaaaggcatgagaatacgcttcaaagacgacagttccttcgaagacgttaacggcatcagaaaacccaaacacctctttctctccatgcccaacgcacaatcctcaatgaaagccgacgaaatcacacctggccgcttccgaaccgccatctgcggactctaccccgcacaagtcaaagccagaaacctcatctcccccgtcatgtccgtcataggattcctcgccctcgccaaaaactggacagaacgcgtcgaagaatggctagacctaccctgcaaactcttatccgagcccagccccacctccctcacaaaaggcccctcaacaaaccgcgactacctcaaccaacgccaaggtgcactcgcaaaaatggaaactaaagaagcccaagccgtccgcaaacacgccatcgacgccggctgcaacctcatcgaccacatcgacagcccgagctccatctgggtcttcgccggcgcaccagaccgctgcccaccaacctgcctcttcatcgccggcatggcagaactcggcgccttcttcgccgtactccaagacatgcgtaacaccatcatggcaagcaagaccatcggaacctccgaagaaaaacttaagaaaaagtcatcattctaccaatcctacctccgccgaacccaaagcatgggcatccaactagaccagcgcataatcgtcctcttcatggtcgactggggaaaagaagcagtcgattccttccacctcggagacgacatggacccagagctacgaggcctcgcgcaagccctcatagaccaaaaagtaaaagagatctccaatcaagaaccactcaaactctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16709 - RNA, 3790 nt, synthetic construct; identical to SEQ ID NO: 16703
  misc_feature 1..3790: note = mRNA product Design2 comprising derived and/or modified sequence from DOBV(DOBV/Ano-Poroia/Afl9/1999)__NC_005234.1__GP (opt11)
  source 1..3790: mol_type = other RNA

SEQ ID NO: 16710 - RNA, 3790 nt, synthetic construct
  misc_feature 1..3790: note = mRNA product Design2 comprising derived and/or modified sequence from DOBV(DOBV/Ano-Poroia/Afl9/1999)__NC_005234.1__IgE-leader_Gn -Gc (opt11)
  source 1..3790: mol_type = other RNA
ggggcgctgcctacggaggtggcagccatctccttctcggcatcaagcttaccatggattggacgtggatactctttctcgtggccgcggccacgcgcgtgcactcgctccgcaacgtgtacgacatgaagatcgagtgcccccactccatcaacttcggcgagagctccgtcaccgggaaggtggagctgccgcccctgctcctgacggacgccgaggccctggtgcccgagagctcctgcaacatggacaaccaccagagcatgtccatcatccagaaggtcaccaaggtgagctggcggaagaaggccgacaaggcccaggccgccaaggactccttcgagaccaccagctccgaggtgaacctcaagggcacgtgcgcgctgagccaccgcatggtcgaggagtcctaccggaaccgccggagcgtgatctgctacgacctgtcctgcaacagcacccactgcaagcccaccatgcacatgatcgtgccggtccactcctgcaacatgatgaagtcctgcctcgtggggctgggcccctaccgcatccagatcgtgtacgagcggacctactgcacgaccggcatcctgaccgaggggaagtgcttcgtccccgaccagtccatcgtgaacgtgatcaagaacggcgtcttcgacatcgccagcgtgagcatcgtgtgcttcttcatccgcgtcaaggggaccaactacaagatcatggcctccatcaagacggccaccgcgaacaactgcaacgacaccgacaacaaggtgcagggctactacctctgcatcgtcgggggcaacagctcccccgtgtacgccccgagcaccacggacttccggtccatggaggccctggccagcctgctccgcgcgccccacggcgaggaccacgacctgtccggggaggaggtggccacctacagcatcgccggccagatcgaggggaagatcccccacaccgccaacgccgccaacatgctgttcaccgcgttctccggcatccccagctactccagcctctccgtgttcatcggcagccaggacgggccggtcatctactcccccggcctgttcccccggctgaaccagagctcctgcgacaagatcgccctccccctgatctgggaggggtacatcgacctgccgggctactacgagacggtgcacccctgcaacgtcttctgcgtgctcagcgggcccggcgcctcctgcgaggccttcagcgagggcgggatcttcaacatcaccagcccgacctgcctggtgtccaagcagaaccgcttccgggccgcggagcagcaggtcaacttcgtgtgccagcgcgtggaccaggacatcgtcatctactgcaacggccagaagaagaccatcctgacgaagaccctcgtgatcgggcagtgcatctacagcgtgacctccctgttcagcatcatgcccggcgtcgcccactccatcgccatcgagctgtgcgtgcccgggttccacggctgggccaccgccgcgctcctgacgaccttctgcttcggctggatcctgatcctcagcatcaccctggccgtgctggtcgtgctcaagttcttcgccgccatcctgcacaactccagccaggagaaccggttcaagatcatcctgcgcaagatcaaggaggagttcgagaagaccaaggggtccatggtgtgcgaggtctgcaagtacgagtgcgagacgggcaaggagctcaaggcgcacaacctgagctgcccccagtcccagtgcccctactgcttcacccactgcgagccgaccgagagcgccttccaggcccactacaaggtgtgccaggccacccaccggttccgcgacgacctgaagaagacgatcacgccccagtccaccagccccgggtgctaccggaccctcaacctgttccgctacaagtcccggtgctacatcttcaccgtgtgggtcaccctgctcatcatcgagagcatcatgtgggccgcgtccgccagcgagaccgtgctggagcccagctggaacgacaacgcccacggcgtgggggtcgtgccgatgcacaccgacctggagctggacttctccctccccagctccagcaagtacacctacaagcgcaagctgacgagccccctgaaccaggagcagagcgtggacctccacatcgagatcgagtcccagggcatcagcacctccgtccacgccctgggccactggttcgacgggcgcctgaacctcaagaccagcttccactgctacggcgcctgcaccaagtacgagtacccgtggcacacggcgaagtgccacttcgagcgggacttcgagtacgagaacaactgggggtgcaaccccgccgactgccccggcatcggcaccgggtgcaccgcctgcggcctgtacatcgaccagctgaagcccgtggggtccgcctacaagctcatcaccgtgcgctacagccggaaggtctgcgtgcagttcggcgaggagaacctgtgcaagacgatcgacatgaacgactgcttcgtgacccgccacgtcaaggtgtgcatcatcgggaccgtgtccaagttcagccagggcgacaccctggtcttcctcggcccgatggagggcggcgggctgatcttcaaggactggtgcacgtccacgtgccagttcggggaccccggggacatcatgagccccaaggacaagggcttctcctgccccgacttcaccggccacttccggaagaagtgcaacttcgccaccaccccggtgtgcgagtacgacgggaacatggtgagcggctacaagaaggtcatggcgaccatcgactccttccagagcttcaacaccagctccatccactacaccgacgagcgcatcgagtggaaggaccccgacgggatgctgaaggaccacctcaacatcctggtgacgaaggacatcgacttcgagaacctgggcgagaacccctgcaaggtggggctccagaccagctccatcgagggcgcctggggcagcggggtcggcttcaccctgacctgccagatctccctgacggagtgcagccggttcctcacctccatcaaggcctgcgacatggccatctgctacggggcgcagagcgtgaccctgatccgcggccagaacaccgtgaaggtctccgggaagggcggccacagcgggtccagcttcaagtgctgccacggcacggactgctcccagcaggggctgcaggccagcgcgccccacctcgacaaggtgaacggcatcgtggagcaggagtccgagaaggtctacgacgacggcgccccgcagtgcgggatcagctgctggttcgtgaagtccggcgagtggatcaccgggatcttcaacggcaactggatcgtgatcgtcgtgctggtgttcttcttcatcctgagcctcatcctgctgtccctcctgtgccccatccggaagcacaagcgcagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16711 - protein, 429 aa, synthetic construct; identical to SEQ ID NO: 279
  REGION 1..429: note = derived and/or modified protein sequence (wt) from HTNV(76-118/POR)__KT885049.1__N

SEQ ID NO: 16712 - protein, 1135 aa, synthetic construct; identical to SEQ ID NO: 949
  REGION 1..1135: note = derived and/or modified protein sequence (wt) from HTNV(76-118/POR)__KT885048.1__GP

SEQ ID NO: 16713 - protein, 1135 aa, synthetic construct
  REGION 1..1135: note = derived and/or modified protein sequence (wt) from HTNV(76-118/POR)__KT885048.1__IgE-leader_Gn-Gc
MDWTWILFLVAAATRVHSLRNVYDMKIECPHTVSFGGNSVIGYVELPPVPLADTAQMVPESSCSMDNHQSLNTITKYTQVSWRGKADQSQSSQNSFETVSTEVDLKGTCVLKHKMVEESYRSRKSVTCYDLSCNSTYCKPTLYMIVPIHACNMMKSCLIALGPYRVQVVYERTYCMTGVLIEGKCFVPDQSVVSIIKHGIFDIASVHIVCFFVAVKGNTYKIFEQVKKSFESTCNDTENKVQGYYICIVGGNSAPIYVPTLDDFRSMEAFTGIFRSPHGEDHDLAGEEIASYSIVGPANAKVPHSASSDTLRLIAYSGIPSYSSLSILTSSTEAKHVFSPGLFPKLNHTNCDKSAIPLIWTGMIDLPGYYEAVHPCTVFCVLSGPGASCEAFSEGGIFNITSSMCLVSKQNRFRLTEQQVNFVCQRVDMDIVVYCNGQRKVILTKTLVIGQCIYTITSLFSLLPGVAHSIAVELCVPGFHGWATAALLVTFCFGWVLIPAITFIILTVLKFIANIFHTSNQENRLKSVLRKIKEEFEKTKGSMVCDVCKYECETYKELKAHGVSCPQSQCPYCFTHCEPTEAAFQAHYKVCQVTHRFRDDLKKTVTPQNFTPGCYRTLNLFRYKSRCYIFTMWIFLLVLESILWAASASETPLTPVWNDNAHGVGSVPMHTDLELDFSLTSSSKYTYRRKLTNPLEEAQSIDLHIEIEEQTIGVDVHALGHWFDGRLNLKTSFHCYGACTKYEYPWHTAKCHYERDYQYETSWGCNPSDCPGVGTGCTACGLYLDQLKPVGSAYKIITIRYSRRVCVQFGEENLCKIIDMNDCFVSRHVKVCIIGTVSKFSQGDTLLFFGPLEGGGLIFKHWCTSTCQFGDPGDIMSPRDKGFLCPEFPGSFRKKCNFATTPICEYDGNMVSGYKKVMATIDSFQSFNTSTMHFTDERIEWKDPDGMLRDHINILVTKDIDFDNLGENPCKIGLQTSSIEGAWGSGVGFTLTCLVSLTECPTFLTSIKACDKAICYGAESVTLTRGQNTVKVSGKGGHSGSTFKCCHGEDCSQIGLHAAAPHLDKVNGISEIENSKVYDDGAPQCGIKCWFVKSGEWISGIFSGNWIVLIVLCVFLLFSLVLLSILCPVRKHKKS

SEQ ID NO: 16714 - RNA, 1290 nt, synthetic construct; identical to SEQ ID NO: 2614
  misc_feature 1..1290: note = derived and/or modified CDS sequence (wt) from HTNV(76-118/POR)__KT885049.1__N
  source 1..1290: mol_type = other RNA

SEQ ID NO: 16715 - RNA, 1290 nt, synthetic construct
  misc_feature 1..1290: note = derived and/or modified CDS sequence (wt) from HTNV(76-118/POR)__KT885049.1__N
  source 1..1290: mol_type = other RNA
atggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagctgcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctgttcatggttgcctggggaaaggaggctgtggacaacttccacttaggggatgatatggatcctgagctaaggacactggcacagagcttgattgatgtcaaagtgaaggaaatctccaaccaagagcctttgaaactctaa

SEQ ID NO: 16716 - RNA, 3408 nt, synthetic construct; identical to SEQ ID NO: 3284
  misc_feature 1..3408: note = derived and/or modified CDS sequence (wt) from HTNV(76-118/POR)__KT885048.1__GP
  source 1..3408: mol_type = other RNA

SEQ ID NO: 16717 - RNA, 3408 nt, synthetic construct
  misc_feature 1..3408: note = derived and/or modified CDS sequence (wt) from HTNV(76-118/POR)__KT885048.1__GP
  source 1..3408: mol_type = other RNA
atggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataaccagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 16718 - RNA, 3408 nt, synthetic construct
  misc_feature 1..3408: note = derived and/or modified CDS sequence (wt) from HTNV(76-118/POR)__KT885048.1__IgE-leader_Gn-Gc
  source 1..3408: mol_type = other RNA
atggactggacctggatcctgttcctcgtggccgccgcgacccgcgtccacagcctgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 16719 - RNA, 3408 nt, synthetic construct
  misc_feature 1..3408: note = derived and/or modified CDS sequence (wt) from HTNV(76-118/POR)__KT885048.1__IgE-leader_Gn-Gc
  source 1..3408: mol_type = other RNA
atggactggacctggatcctgttcctcgtggccgccgcgacccgcgtccacagcctgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataaccagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatag

SEQ ID NO: 16720 - RNA, 1290 nt, synthetic construct; identical to SEQ ID NO: 4949
  misc_feature 1..1290: note = derived and/or modified CDS sequence (opt4) from HTNV(76-118/POR)__KT885049.1__N
  source 1..1290: mol_type = other RNA

SEQ ID NO: 16721 - RNA, 3408 nt, synthetic construct; identical to SEQ ID NO: 8387
  misc_feature 1..3408: note = derived and/or modified CDS sequence (opt4) from HTNV(76-118/POR)__KT885048.1__GP
  source 1..3408: mol_type = other RNA

SEQ ID NO: 16722 - RNA, 3408 nt, synthetic construct
  misc_feature 1..3408: note = derived and/or modified CDS sequence (opt4) from HTNV(76-118/POR)__KT885048.1__IgE-leader_Gn-Gc
  source 1..3408: mol_type = other RNA
atggactggacctggatcctgttcctggtggccgccgccaccagagtgcacagcctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctga

SEQ ID NO: 16723 - RNA, 1290 nt, synthetic construct; identical to SEQ ID NO: 5641
  misc_feature 1..1290: note = derived and/or modified CDS sequence (opt3) from HTNV(76-118/POR)__KT885049.1__N
  source 1..1290: mol_type = other RNA

SEQ ID NO: 16724 - RNA, 3408 nt, synthetic construct; identical to SEQ ID NO: 10030
  misc_feature 1..3408: note = derived and/or modified CDS sequence (opt3) from HTNV(76-118/POR)__KT885048.1__GP
  source 1..3408: mol_type = other RNA

SEQ ID NO: 16725 - RNA, 3408 nt, synthetic construct
  misc_feature 1..3408: note = derived and/or modified CDS sequence (opt3) from HTNV(76-118/POR)__KT885048.1__IgE-leader_Gn-Gc
  source 1..3408: mol_type = other RNA
atggactggacctggatcctgttcctcgtggccgctgcaacaagagtccacagcctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcagtatcctgtgcccggtgcgaaaacacaaaaagagctga

SEQ ID NO: 16726 - RNA, 1290 nt, synthetic construct; identical to SEQ ID NO: 6333
  misc_feature 1..1290: note = derived and/or modified CDS sequence (opt1) from HTNV(76-118/POR)__KT885049.1__N
  source 1..1290: mol_type = other RNA

SEQ ID NO: 16727 - RNA, 3408 nt, synthetic construct; identical to SEQ ID NO: 11673
  misc_feature 1..3408: note = derived and/or modified CDS sequence (opt1) from HTNV(76-118/POR)__KT885048.1__GP
  source 1..3408: mol_type = other RNA

SEQ ID NO: 16728 - RNA, 3408 nt, synthetic construct
  misc_feature 1..3408: note = derived and/or modified CDS sequence (opt1) from HTNV(76-118/POR)__KT885048.1__IgE-leader_Gn-Gc
  source 1..3408: mol_type = other RNA
atggactggacctggatcctgttcctcgtggccgccgcgacccgcgtccacagcctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcgcaagcacaagaagtcctga

SEQ ID NO: 16729 - RNA, 1290 nt, synthetic construct; identical to SEQ ID NO: 7025
  misc_feature 1..1290: note = derived and/or modified CDS sequence (opt5) from HTNV(76-118/POR)__KT885049.1__N
  source 1..1290: mol_type = other RNA

SEQ ID NO: 16730 - RNA, 3408 nt, synthetic construct; identical to SEQ ID NO: 13316
  misc_feature 1..3408: note = derived and/or modified CDS sequence (opt5) from HTNV(76-118/POR)__KT885048.1__GP
  source 1..3408: mol_type = other RNA

SEQ ID NO: 16731 - RNA, 3408 nt, synthetic construct
  misc_feature 1..3408: note = derived and/or modified CDS sequence (opt5) from HTNV(76-118/POR)__KT885048.1__IgE-leader_Gn-Gc
  source 1..3408: mol_type = other RNA
atggactggacctggatcctgttcctcgtggccgctgccacaagagtccacagccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtcaagagcggggagtggatctccggaattttctctggcaattggatcgtgctcattgtgctgtgtgtttttcttctgttcagcctcgtgctgctgtccatcctttgccctgtccgcaaacacaaaaagagctga

SEQ ID NO: 16732 - RNA, 1290 nt, synthetic construct; identical to SEQ ID NO: 7717
  misc_feature 1..1290: note = derived and/or modified CDS sequence (opt11) from HTNV(76-118/POR)__KT885049.1__N
  source 1..1290: mol_type = other RNA

SEQ ID NO: 16733 - RNA, 3408 nt, synthetic construct; identical to SEQ ID NO: 14959
  misc_feature 1..3408: note = derived and/or modified CDS sequence (opt11) from HTNV(76-118/POR)__KT885048.1__GP
  source 1..3408: mol_type = other RNA

SEQ ID NO: 16734 - RNA, 3408 nt, synthetic construct
  misc_feature 1..3408: note = derived and/or modified CDS sequence (opt11) from HTNV(76-118/POR)__KT885048.1__IgE-leader_Gn-Gc
  source 1..3408: mol_type = other RNA
atggattggacgtggatactctttctcgtggccgcggccacgcgcgtgcactcgctgcgcaacgtgtatgacatgaagatcgagtgcccgcacacagtctccttcgggggtaacagcgttatcgggtacgtggagctcccgcccgtccccttggccgacacggcgcagatggtccccgagtcatcgtgctccatggacaaccaccagagcctgaacacaatcaccaagtacacccaggtgtcctggcggggcaaggcggaccagagccagtccagccagaactccttcgagacggtcagcacagaggtggacctcaaggggacctgtgtactgaagcacaagatggtcgaggagtcctaccgcagccggaagtccgtgacctgctacgacctgagctgcaactccacatactgcaagcccaccctctacatgatcgtgcccatccacgcctgcaacatgatgaagtcttgcctgatagcactgggcccctatcgcgtccaggtggtttacgagcggacgtactgcatgaccggcgtcctcatcgagggcaagtgcttcgtgccggaccagtccgtggtcagtatcatcaaacacggcatcttcgacatcgccagcgtgcacatcgtttgcttcttcgtcgctgttaagggaaacacgtacaagatcttcgagcaggtcaagaagtccttcgagagcacatgcaacgacaccgagaacaaggtgcaaggctactacatctgcatcgtcgggggcaactccgctcccatctacgtgcccaccctggacgacttccgcagcatggaggccttcacagggatcttccggagcccccacggggaggaccacgacctggccggcgaggagatcgcgagctactccatcgtggggccggccaacgccaaagtgccccacagcgccagcagcgacaccctccgcctgatagcctactccggcatccccagctactccagcttgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtccacccctgcacagtgttctgtgtcctgagcgggccaggcgcctcctgcgaggccttctccgagggcggaatcttcaacatcaccagctccatgtgcctcgtgtccaagcaaaaccggttccgcctgaccgagcaacaggtcaacttcgtgtgtcagcgggtggacatggacatcgtcgtctactgtaatggccagcgcaaggtgatcctgactaagaccctcgtgatcgggcagtgcatctacaccatcacgtccctgttcagcctgctccccggcgtagcgcactccatcgccgtggagctgtgcgtgcccgggttccacggctgggccacggcggccctgctcgtcaccttctgcttcgggtgggtgcttatccccgcgatcaccttcatcatcctgacggtgctcaagttcatcgccaacatcttccacacgagcaaccaggagaaccgtctgaagtccgtcctgcggaagatcaaggaggagttcgaaaagaccaagggctcaatggtgtgcgatgtgtgcaagtacgagtgcgagacctacaaagagctcaaggcccacggcgtatcctgcccgcagagtcagtgcccctactgcttcacgcattgcgagcccaccgaggccgccttccaggcgcactataaggtgtgtcaggtgacccaccggttccgcgacgacctgaagaagaccgtcacaccccagaacttcaccccgggctgctaccggaccctgaacctcttccgctacaagtcccggtgctacatcttcaccatgtggatcttcctgctggtgctcgaaagcatcctgtgggccgcctccgccagcgagacgcccttgacccccgtgtggaacgacaacgcgcacggcgtcgggtccgtgccgatgcacaccgacctcgagctggacttcagcctgactagctccagcaagtacacctaccggcgaaagctgacgaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcacgaagtatgagtatccctggcacacggccaagtgccactacgagcgcgactaccagtacgagacctcctggggatgcaaccccagcgattgtccgggcgtggggaccggctgtaccgcgtgcggcctgtacctcgaccagctgaagcccgtggggtccgcctacaagatcatcacgatccgatacagccgtagggtctgcgtgcagttcggcgaggagaatctgtgtaagatcatcgacatgaacgactgcttcgtgtcccgccacgtcaaggtgtgcatcatcgggaccgtgagcaagttttcccagggcgacacgctcctgttctttggccccctggagggcggcgggctcatctttaagcactggtgcaccagcacgtgccagtttggcgaccccggggacatcatgtccccgcgcgacaagggcttcctgtgccccgagttccccgggagcttccgcaagaaatgcaactttgcgaccacccctatctgcgagtacgacggcaacatggtctccggctacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacttgggcgagaatccctgcaagatcgggctgcagacctccagcatcgagggcgcctgggggagcggcgtcggcttcaccctaacctgcctcgtgtccctgaccgaatgtcccacgttcctcaccagcatcaaagcgtgcgataaggccatctgctacggggcggagtccgtgaccctgacccgaggccagaacacggtcaaggtgagcgggaagggcggacactccggcagcaccttcaagtgctgccacggcgaggactgctcccagatcgggctgcacgccgcggcgccccacctcgacaaggtcaacggcatctcagaaatcgagaactccaaggtgtacgacgatggggcacctcagtgtggcatcaaatgctggttcgtcaagagcggcgagtggatctccgggatcttcagcggcaactggatcgtgttgattgtcctgtgcgtgttcctcctgttctccctggtcctcctgagcatcctgtgccccgtgcgcaagcacaagaaatcctga

SEQ ID NO: 16735 - RNA, 1507 nt, synthetic construct
  misc_feature 1..1507: note = mRNA product Design1 comprising derived and/or modified sequence from HTNV(76-118/POR)__KT885049.1__N (wt)
  source 1..1507: mol_type = other RNA
gggagaaagcttaccatggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16736 - RNA, 1507 nt, synthetic construct
  misc_feature 1..1507: note = mRNA product Design1 comprising derived and/or modified sequence from HTNV(76-118/POR)__KT885049.1__N (wt)
  source 1..1507: mol_type = other RNA
gggagaaagcttaccatggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagctgcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctgttcatggttgcctggggaaaggaggctgtggacaacttccacttaggggatgatatggatcctgagctaaggacactggcacagagcttgattgatgtcaaagtgaaggaaatctccaaccaagagcctttgaaactctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16737 - RNA, 3625 nt, synthetic construct
  misc_feature 1..3625: note = mRNA product Design1 comprising derived and/or modified sequence from HTNV(76-118/POR)__KT885048.1__GP (wt)
  source 1..3625: mol_type = other RNA
gggagaaagcttaccatggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16738 - RNA, 3625 nt, synthetic construct
  misc_feature 1..3625: note = mRNA product Design1 comprising derived and/or modified sequence from HTNV(76-118/POR)__KT885048.1__GP (wt)
  source 1..3625: mol_type = other RNA
gggagaaagcttaccatggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataaccagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16739 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (wt)
  source 1..3625: mol_type = other RNA
gggagaaagcttaccatggactggacctggatcctgttcctcgtggccgccgcgacccgcgtccacagcctgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16740 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (wt)
  source 1..3625: mol_type = other RNA
gggagaaagcttaccatggactggacctggatcctgttcctcgtggccgccgcgacccgcgtccacagcctgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataaccagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16741 - RNA, 1507 nt, synthetic construct
  misc_feature 1..1507: note = mRNA product Design1 comprising derived and/or modified sequence from HTNV(76-118/POR)__KT885049.1__N (opt4)
  source 1..1507: mol_type = other RNA
gggagaaagcttaccatggccaccatggaggagctgcagagagagatcaacgcccacgagggccagctggtgatcgccagacagaaggtgagagacgccgagaagcagtacgagaaggaccccgacgagctgaacaagagagccctgaccaacagagagggcgtggccgtgagcatccaggccaagatcgacgagctgaagatgcagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16742 - RNA, 3625 nt, synthetic construct
  misc_feature 1..3625: note = mRNA product Design1 comprising derived and/or modified sequence from HTNV(76-118/POR)__KT885048.1__GP (opt4)
  source 1..3625: mol_type = other RNA
gggagaaagcttaccatgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16743 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (opt4)
  source 1..3625: mol_type = other RNA
gggagaaagcttaccatggactggacctggatcctgttcctggtggccgccgccaccagagtgcacagcctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16744 - RNA, 1507 nt, synthetic construct
  misc_feature 1..1507: note = mRNA product Design1 comprising derived and/or modified sequence from HTNV(76-118/POR)__KT885049.1__N (opt3)
  source 1..1507: mol_type = other RNA
gggagaaagcttaccatggccaccatggaggaactgcagagagagatcaacgctcacgaaggccaactcgtgattgcaaggcagaaggtccgggacgccgagaaacagtacgaaaaggatcccgacgagcttaataaacgcgcgctgacaaaccgagagggggttgctgtgagcatacaggccaagatcgatgaattgaaaatgcaattagcagaccgtattgccactggaaagaatctgggtaaggagcaggatcctacgggcgtagaaccaggggaccatctaaaagagagatccatgctctcttatggaaacgtgctggatcttaatcacctggacatcgatgagccgaccggccagacagctgactggttgtcaattatcgtctacctcaccagtttcgtggttcccatactgctgaaggcactctatatgttaactacaaggggtcggcagaccactaaagataacaaggggacacgcatcagatttaaagacgatagctccttcgaagacgtgaatggaattaggaagcctaagcatctgtacgtctctcttccaaacgcccaatcgtcaatgaaagctgaggaaatcacccccggccggtatcgcacggccgtgtgcggcttgtaccctgcgcagattaaggcacgacagatgatcagcccagtaatgagtgttatagggtttctggccctagctaaagactggtccgatagaattgagcagtggctcatcgaaccctgtaagctgcttcctgacactgccgcagtgtctctgttgggaggtccagctaccaatagggattatctccggcaacgtcaggtcgccctgggcaacatggagacaaaagagagcaaggcgattcgccagcacgccgaagcagctgggtgctccatgatcgaggacatcgaatcaccgagtagcatttgggtgttcgccggagctcccgatagatgtcctccaacttgcttatttatagccggcatcgcagagctgggtgccttcttttctattctccaagacatgaggaataccatcatggcttccaaaacagtggggacctcagaagagaagctgcggaagaaaagcagtttctaccagtcttaccttcgacgcacgcagtccatgggaatacagttggatcaaagaattatcgtcctatttatggttgcgtggggcaaggaggcagtggacaacttccatctgggcgatgacatggatcccgaactcaggactctggcccagagccttatcgacgtaaaagtgaaggagatttcgaatcaggaacctctgaaattgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16745 - RNA, 3625 nt, synthetic construct
  misc_feature 1..3625: note = mRNA product Design1 comprising derived and/or modified sequence from HTNV(76-118/POR)__KT885048.1__GP (opt3)
  source 1..3625: mol_type = other RNA
gggagaaagcttaccatgggcatctggaagtggctggtgatggccagcctcgtctggcccgttcttaccctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcagtatcctgtgcccggtgcgaaaacacaaaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16746 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (opt3)
  source 1..3625: mol_type = other RNA
gggagaaagcttaccatggactggacctggatcctgttcctcgtggccgctgcaacaagagtccacagcctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcagtatcctgtgcccggtgcgaaaacacaaaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16747 - RNA, 1507 nt, synthetic construct
  misc_feature 1..1507: note = mRNA product Design1 comprising derived and/or modified sequence from HTNV(76-118/POR)__KT885049.1__N (opt1)
  source 1..1507: mol_type = other RNA
gggagaaagcttaccatggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccaaccgcgagggggtggccgtgagcatccaggccaagatcgacgagctcaagatgcagctggcggaccggatcgccacgggcaagaacctggggaaggagcaggaccccaccggcgtcgagcccggggaccacctcaaggagcgctccatgctgagctacggcaacgtgctggacctcaaccacctggacatcgacgagcccaccggccagaccgccgactggctgtccatcatcgtgtacctcacgagcttcgtcgtgcccatcctgctgaaggccctctacatgctgaccacccgggggcgccagaccacgaaggacaacaagggcacccggatccgcttcaaggacgactccagcttcgaggacgtgaacgggatccggaagccgaagcacctgtacgtctccctccccaacgcgcagagctccatgaaggccgaggagatcacccccggccgctaccggaccgccgtgtgcgggctgtaccccgcccagatcaaggcccgccagatgatcagcccggtgatgtccgtcatcggcttcctggcgctcgccaaggactggagcgaccggatcgagcagtggctgatcgagccctgcaagctgctccccgacacggccgccgtgtccctgctgggcgggcccgccaccaaccgcgactacctccggcagcgccaggtggcgctgggcaacatggagaccaaggagagcaaggccatccggcagcacgccgaggccgccgggtgctccatgatcgaggacatcgagagcccgtccagcatctgggtcttcgcgggcgcccccgaccgctgcccgccgacctgcctgttcatcgccggcatcgccgagctcggggccttcttctccatcctgcaggacatgcggaacacgatcatggcgagcaagaccgtgggcaccagcgaggagaagctgcgcaagaagtccagcttctaccagtcctacctccgccggacccagagcatggggatccagctggaccagcgcatcatcgtgctgttcatggtcgcctggggcaaggaggccgtggacaacttccacctcggggacgacatggaccccgagctgcggacgctggcccagtccctcatcgacgtgaaggtcaaggagatcagcaaccaggagcccctgaagctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16748 - RNA, 3625 nt, synthetic construct
  misc_feature 1..3625: note = mRNA product Design1 comprising derived and/or modified sequence from HTNV(76-118/POR)__KT885048.1__GP (opt1)
  source 1..3625: mol_type = other RNA
gggagaaagcttaccatgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcgcaagcacaagaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16749 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (opt1)
  source 1..3625: mol_type = other RNA
gggagaaagcttaccatggactggacctggatcctgttcctcgtggccgccgcgacccgcgtccacagcctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcgcaagcacaagaagtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16750 - RNA, 1507 nt, synthetic construct
  misc_feature 1..1507: note = mRNA product Design1 comprising derived and/or modified sequence from HTNV(76-118/POR)__KT885049.1__N (opt5)
  source 1..1507: mol_type = other RNA
gggagaaagcttaccatggccaccatggaggaactgcagagagagatcaacgctcacgaaggccaactcgtgattgcccggcagaaggtccgcgacgcggagaaacagtacgaaaaggatcccgacgagctgaataaaagagctcttacaaaccgggagggggttgccgtgagcatccaggccaagattgatgaactgaaaatgcaactcgctgaccgcatcgccacgggaaagaatctgggcaaggagcaggatcctaccggggtggaaccgggagaccatcttaaagagagatccatgctgtcttatggcaacgtcctcgatctgaatcacctggacattgatgagcccacagggcagaccgctgactggctcagcatcatcgtgtacctgacatccttcgttgtgcctattcttctgaaggccctctatatgctgaccacacggggacgccagaccacgaaagataacaagggcaccagaatccggtttaaagacgattctagcttcgaagacgtcaatggcattcgcaagcccaagcatctttacgtgtccctgcctaacgcgcaatctagcatgaaagccgaggaaatcacacccgggagatatcggaccgctgtttgcggactctaccctgcccagattaaggctcgccagatgatctccccggtgatgagcgtcattggctttctggccctggcgaaagactggtctgatagaatcgagcagtggctcatcgaaccctgtaagctgcttcctgacacagccgctgtgtccctgctcgggggacccgccaccaatcgggattatctgcgccaaagacaggtggctcttggcaacatggagacgaaagagagcaaggccattcggcagcacgccgaagctgcggggtgctctatgatcgaggacattgaatcccctagctctatctgggtcttcgccggagctcccgatagatgtccgcctacatgcctgtttattgccggcatcgccgagctcggcgctttcttttccatcctgcaagacatgcgcaataccattatggccagcaaaacagttgggacctccgaagagaagctgcggaagaaatctagcttctaccagtcctacctcagacgcacccagagcatgggaatccagctggatcaacggattatcgtgctttttatggtggcgtggggcaaggaggctgtcgacaacttccatctgggggatgacatggatcccgaactcagaacactggcccagtctcttattgacgtgaaagttaaggagatctccaatcaggaacctctgaaactctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16751 - RNA, 3625 nt, synthetic construct
  misc_feature 1..3625: note = mRNA product Design1 comprising derived and/or modified sequence from HTNV(76-118/POR)__KT885048.1__GP (opt5)
  source 1..3625: mol_type = other RNA
gggagaaagcttaccatgggcatctggaagtggctggtgatggccagcctcgtctggcccgttctgacccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtcaagagcggggagtggatctccggaattttctctggcaattggatcgtgctcattgtgctgtgtgtttttcttctgttcagcctcgtgctgctgtccatcctttgccctgtccgcaaacacaaaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16752 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (opt5)
  source 1..3625: mol_type = other RNA
gggagaaagcttaccatggactggacctggatcctgttcctcgtggccgctgccacaagagtccacagccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtcaagagcggggagtggatctccggaattttctctggcaattggatcgtgctcattgtgctgtgtgtttttcttctgttcagcctcgtgctgctgtccatcctttgccctgtccgcaaacacaaaaagagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16753 - RNA, 1507 nt, synthetic construct
  misc_feature 1..1507: note = mRNA product Design1 comprising derived and/or modified sequence from HTNV(76-118/POR)__KT885049.1__N (opt11)
  source 1..1507: mol_type = other RNA
gggagaaagcttaccatggccaccatggaggaactccaacgagagataaacgcccacgaaggccagctagtcatcgccagacaaaaagtccgagacgccgaaaaacaatacgaaaaagaccccgacgaactcaacaagagagccctaaccaaccgagaaggcgtcgcagtctccatccaagcaaaaatcgacgaactcaaaatgcaactagcagacagaatagctaccggcaaaaacctcggaaaagagcaagaccccacaggcgtagaacccggcgaccacctcaaagaaagatccatgctctcatacggcaacgtactagacctcaaccacctcgacatagacgaacccaccgggcaaacagccgactggctctccataatcgtctacctcacctccttcgtcgtcccaatcctcctcaaagcactatacatgctaaccacccggggcagacaaactaccaaagacaacaaaggcacccggatcagattcaaggacgacagctcattcgaagacgtgaacggcatccgaaaacccaaacacctttacgtctccctccccaacgcacaatcaagcatgaaagccgaagaaatcacgcctggccgctaccgaaccgcagtatgcggcctctaccccgcacaaatcaaagccagacaaatgatctcccccgtcatgtcagtaataggtttcctcgccctcgccaaagactggagcgaccgcatcgaacaatggctgatcgaaccatgcaaactcctccccgacacagccgcggtcagcctcctaggcggaccagccacaaacagagactacctcagacaacgccaagtcgccctcggcaacatggaaaccaaagaaagcaaagcaatacgacagcacgccgaagcggccggatgctccatgatcgaagacatagaaagcccaagctcaatatgggtcttcgccggcgcccccgaccgctgcccaccaacctgcctcttcatcgccggaatcgcagaacttggcgccttcttctctatcctccaagacatgcgcaacaccatcatggcaagcaaaacagtcggcaccagcgaggagaaactaagaaagaaatcctccttctaccaatcatacctcagacgcacccagtccatgggcatacaactcgaccaacgaatcatagtcctcttcatggtagcatggggcaaagaagcagtcgacaacttccacctaggcgatgacatggaccccgaactccgcaccctcgcccaaagcctcatcgacgtaaaagtcaaagaaatctccaaccaagaacccctcaaactctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16754 - RNA, 3625 nt, synthetic construct
  misc_feature 1..3625: note = mRNA product Design1 comprising derived and/or modified sequence from HTNV(76-118/POR)__KT885048.1__GP (opt11)
  source 1..3625: mol_type = other RNA
gggagaaagcttaccatgggcatctggaagtggctggtgatggcaagcctcgtctggcccgtgcttaccctgcgcaacgtgtatgacatgaagatcgagtgcccgcacacagtctccttcgggggtaacagcgttatcgggtacgtggagctcccgcccgtccccttggccgacacggcgcagatggtccccgagtcatcgtgctccatggacaaccaccagagcctgaacacaatcaccaagtacacccaggtgtcctggcggggcaaggcggaccagagccagtccagccagaactccttcgagacggtcagcacagaggtggacctcaaggggacctgtgtactgaagcacaagatggtcgaggagtcctaccgcagccggaagtccgtgacctgctacgacctgagctgcaactccacatactgcaagcccaccctctacatgatcgtgcccatccacgcctgcaacatgatgaagtcttgcctgatagcactgggcccctatcgcgtccaggtggtttacgagcggacgtactgcatgaccggcgtcctcatcgagggcaagtgcttcgtgccggaccagtccgtggtcagtatcatcaaacacggcatcttcgacatcgccagcgtgcacatcgtttgcttcttcgtcgctgttaagggaaacacgtacaagatcttcgagcaggtcaagaagtccttcgagagcacatgcaacgacaccgagaacaaggtgcaaggctactacatctgcatcgtcgggggcaactccgctcccatctacgtgcccaccctggacgacttccgcagcatggaggccttcacagggatcttccggagcccccacggggaggaccacgacctggccggcgaggagatcgcgagctactccatcgtggggccggccaacgccaaagtgccccacagcgccagcagcgacaccctccgcctgatagcctactccggcatccccagctactccagcttgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtccacccctgcacagtgttctgtgtcctgagcgggccaggcgcctcctgcgaggccttctccgagggcggaatcttcaacatcaccagctccatgtgcctcgtgtccaagcaaaaccggttccgcctgaccgagcaacaggtcaacttcgtgtgtcagcgggtggacatggacatcgtcgtctactgtaatggccagcgcaaggtgatcctgactaagaccctcgtgatcgggcagtgcatctacaccatcacgtccctgttcagcctgctccccggcgtagcgcactccatcgccgtggagctgtgcgtgcccgggttccacggctgggccacggcggccctgctcgtcaccttctgcttcgggtgggtgcttatccccgcgatcaccttcatcatcctgacggtgctcaagttcatcgccaacatcttccacacgagcaaccaggagaaccgtctgaagtccgtcctgcggaagatcaaggaggagttcgaaaagaccaagggctcaatggtgtgcgatgtgtgcaagtacgagtgcgagacctacaaagagctcaaggcccacggcgtatcctgcccgcagagtcagtgcccctactgcttcacgcattgcgagcccaccgaggccgccttccaggcgcactataaggtgtgtcaggtgacccaccggttccgcgacgacctgaagaagaccgtcacaccccagaacttcaccccgggctgctaccggaccctgaacctcttccgctacaagtcccggtgctacatcttcaccatgtggatcttcctgctggtgctcgaaagcatcctgtgggccgcctccgccagcgagacgcccttgacccccgtgtggaacgacaacgcgcacggcgtcgggtccgtgccgatgcacaccgacctcgagctggacttcagcctgactagctccagcaagtacacctaccggcgaaagctgacgaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcacgaagtatgagtatccctggcacacggccaagtgccactacgagcgcgactaccagtacgagacctcctggggatgcaaccccagcgattgtccgggcgtggggaccggctgtaccgcgtgcggcctgtacctcgaccagctgaagcccgtggggtccgcctacaagatcatcacgatccgatacagccgtagggtctgcgtgcagttcggcgaggagaatctgtgtaagatcatcgacatgaacgactgcttcgtgtcccgccacgtcaaggtgtgcatcatcgggaccgtgagcaagttttcccagggcgacacgctcctgttctttggccccctggagggcggcgggctcatctttaagcactggtgcaccagcacgtgccagtttggcgaccccggggacatcatgtccccgcgcgacaagggcttcctgtgccccgagttccccgggagcttccgcaagaaatgcaactttgcgaccacccctatctgcgagtacgacggcaacatggtctccggctacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacttgggcgagaatccctgcaagatcgggctgcagacctccagcatcgagggcgcctgggggagcggcgtcggcttcaccctaacctgcctcgtgtccctgaccgaatgtcccacgttcctcaccagcatcaaagcgtgcgataaggccatctgctacggggcggagtccgtgaccctgacccgaggccagaacacggtcaaggtgagcgggaagggcggacactccggcagcaccttcaagtgctgccacggcgaggactgctcccagatcgggctgcacgccgcggcgccccacctcgacaaggtcaacggcatctcagaaatcgagaactccaaggtgtacgacgatggggcacctcagtgtggcatcaaatgctggttcgtcaagagcggcgagtggatctccgggatcttcagcggcaactggatcgtgttgattgtcctgtgcgtgttcctcctgttctccctggtcctcctgagcatcctgtgccccgtgcgcaagcacaagaaatcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16755 - RNA, 3625 nt, synthetic construct
  misc_feature 1..3625: note = mRNA product Design1 comprising derived and/or modified sequence from HTNV(76-118/POR)__KT885048.1__IgE-leader_Gn-Gc (opt11)
  source 1..3625: mol_type = other RNA
gggagaaagcttaccatggattggacgtggatactctttctcgtggccgcggccacgcgcgtgcactcgctgcgcaacgtgtatgacatgaagatcgagtgcccgcacacagtctccttcgggggtaacagcgttatcgggtacgtggagctcccgcccgtccccttggccgacacggcgcagatggtccccgagtcatcgtgctccatggacaaccaccagagcctgaacacaatcaccaagtacacccaggtgtcctggcggggcaaggcggaccagagccagtccagccagaactccttcgagacggtcagcacagaggtggacctcaaggggacctgtgtactgaagcacaagatggtcgaggagtcctaccgcagccggaagtccgtgacctgctacgacctgagctgcaactccacatactgcaagcccaccctctacatgatcgtgcccatccacgcctgcaacatgatgaagtcttgcctgatagcactgggcccctatcgcgtccaggtggtttacgagcggacgtactgcatgaccggcgtcctcatcgagggcaagtgcttcgtgccggaccagtccgtggtcagtatcatcaaacacggcatcttcgacatcgccagcgtgcacatcgtttgcttcttcgtcgctgttaagggaaacacgtacaagatcttcgagcaggtcaagaagtccttcgagagcacatgcaacgacaccgagaacaaggtgcaaggctactacatctgcatcgtcgggggcaactccgctcccatctacgtgcccaccctggacgacttccgcagcatggaggccttcacagggatcttccggagcccccacggggaggaccacgacctggccggcgaggagatcgcgagctactccatcgtggggccggccaacgccaaagtgccccacagcgccagcagcgacaccctccgcctgatagcctactccggcatccccagctactccagcttgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtccacccctgcacagtgttctgtgtcctgagcgggccaggcgcctcctgcgaggccttctccgagggcggaatcttcaacatcaccagctccatgtgcctcgtgtccaagcaaaaccggttccgcctgaccgagcaacaggtcaacttcgtgtgtcagcgggtggacatggacatcgtcgtctactgtaatggccagcgcaaggtgatcctgactaagaccctcgtgatcgggcagtgcatctacaccatcacgtccctgttcagcctgctccccggcgtagcgcactccatcgccgtggagctgtgcgtgcccgggttccacggctgggccacggcggccctgctcgtcaccttctgcttcgggtgggtgcttatccccgcgatcaccttcatcatcctgacggtgctcaagttcatcgccaacatcttccacacgagcaaccaggagaaccgtctgaagtccgtcctgcggaagatcaaggaggagttcgaaaagaccaagggctcaatggtgtgcgatgtgtgcaagtacgagtgcgagacctacaaagagctcaaggcccacggcgtatcctgcccgcagagtcagtgcccctactgcttcacgcattgcgagcccaccgaggccgccttccaggcgcactataaggtgtgtcaggtgacccaccggttccgcgacgacctgaagaagaccgtcacaccccagaacttcaccccgggctgctaccggaccctgaacctcttccgctacaagtcccggtgctacatcttcaccatgtggatcttcctgctggtgctcgaaagcatcctgtgggccgcctccgccagcgagacgcccttgacccccgtgtggaacgacaacgcgcacggcgtcgggtccgtgccgatgcacaccgacctcgagctggacttcagcctgactagctccagcaagtacacctaccggcgaaagctgacgaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcacgaagtatgagtatccctggcacacggccaagtgccactacgagcgcgactaccagtacgagacctcctggggatgcaaccccagcgattgtccgggcgtggggaccggctgtaccgcgtgcggcctgtacctcgaccagctgaagcccgtggggtccgcctacaagatcatcacgatccgatacagccgtagggtctgcgtgcagttcggcgaggagaatctgtgtaagatcatcgacatgaacgactgcttcgtgtcccgccacgtcaaggtgtgcatcatcgggaccgtgagcaagttttcccagggcgacacgctcctgttctttggccccctggagggcggcgggctcatctttaagcactggtgcaccagcacgtgccagtttggcgaccccggggacatcatgtccccgcgcgacaagggcttcctgtgccccgagttccccgggagcttccgcaagaaatgcaactttgcgaccacccctatctgcgagtacgacggcaacatggtctccggctacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacttgggcgagaatccctgcaagatcgggctgcagacctccagcatcgagggcgcctgggggagcggcgtcggcttcaccctaacctgcctcgtgtccctgaccgaatgtcccacgttcctcaccagcatcaaagcgtgcgataaggccatctgctacggggcggagtccgtgaccctgacccgaggccagaacacggtcaaggtgagcgggaagggcggacactccggcagcaccttcaagtgctgccacggcgaggactgctcccagatcgggctgcacgccgcggcgccccacctcgacaaggtcaacggcatctcagaaatcgagaactccaaggtgtacgacgatggggcacctcagtgtggcatcaaatgctggttcgtcaagagcggcgagtggatctccgggatcttcagcggcaactggatcgtgttgattgtcctgtgcgtgttcctcctgttctccctggtcctcctgagcatcctgtgccccgtgcgcaagcacaagaaatcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16756 - RNA, 1672 nt, synthetic construct
  misc_feature 1..1672: note = mRNA product Design2 comprising derived and/or modified sequence from HTNV(76-118/POR)__KT885049.1__N (wt)
  source 1..1672: mol_type = other RNA
ggggcgctgcctacggaggtggcagccatctccttctcggcatcaagcttaccatggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagcttcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctcttcatggttgcctggggaaaggaggctgtggacaacttccacttaggggatgatatggatcctgagctaaggacactggcacagagcttgattgatgtcaaagtgaaggaaatctccaaccaagagcctttgaaactctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16757 - RNA, 1672 nt, synthetic construct
  misc_feature 1..1672: note = mRNA product Design2 comprising derived and/or modified sequence from HTNV(76-118/POR)__KT885049.1__N (wt)
  source 1..1672: mol_type = other RNA
ggggcgctgcctacggaggtggcagccatctccttctcggcatcaagcttaccatggcaactatggaggaattacagagggaaatcaatgcccatgagggtcaattagtgatagccaggcagaaggtgagggatgcagaaaaacagtatgaaaaggatccagatgagttgaacaagagagcattaactaaccgagagggcgttgcagtatctatccaggcaaaaattgatgagttaaaaatgcaactggcagataggattgcaactgggaaaaaccttgggaaggaacaagatccaacaggggtggagcctggagaccatctgaaagagaggtcaatgctcagttatggtaatgtgctggatttaaaccatttggatattgatgaacctacaggacagacagcagactggctgagcatcatcgtctatcttacatcctttgtcgtcccgatacttctgaaagctctgtatatgttgacaacaagggggaggcaaactaccaaggataataaagggacccggattcgatttaaggatgatagctcgttcgaggatgttaacggtatccggaaaccaaaacatctttacgtgtccttgccaaatgcacagtcaagcatgaaggcagaagagattacacctggtagatatagaacagcagtctgtgggctctaccctgcacagattaaggcacggcagatgatcagtccagttatgagtgtaattggttttctagcattagcaaaggactggagtgatcgtatcgaacaatggttaattgaaccttgcaagctgcttccagatacagcagcagttagcctccttggtggtcctgcaacaaacagggactacttacggcagcggcaagtggcattaggcaatatggagacaaaggagtcaaaggctatacgccagcatgcagaagcagctggctgtagcatgattgaagatattgagtcaccatcatcaatatgggtttttgctggagcaccagaccgttgtccaccaacatgtttgtttatagcaggtattgctgagcttggggcatttttttccatcctgcaggacatgcgaaatacaatcatggcatctaagacagttggaacatctgaggagaagctacggaagaaatcatcattttatcagtcctacctcagaaggacacaatcaatggggatacaactagaccagagaattattgtgctgttcatggttgcctggggaaaggaggctgtggacaacttccacttaggggatgatatggatcctgagctaaggacactggcacagagcttgattgatgtcaaagtgaaggaaatctccaaccaagagcctttgaaactctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16758 - RNA, 3790 nt, synthetic construct
  misc_feature 1..3790: note = mRNA product Design2 comprising derived and/or modified sequence from HTNV(76-118/POR)__KT885048.1__GP (wt)
  source 1..3790: mol_type = other RNA
ggggcgctgcctacggaggtggcagccatctccttctcggcatcaagcttaccatggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16759 - RNA, 3790 nt, synthetic construct
  misc_feature 1..3790: note = mRNA product Design2 comprising derived and/or modified sequence from HTNV(76-118/POR)__KT885048.1__GP (wt)
  source 1..3790: mol_type = other RNA
ggggcgctgcctacggaggtggcagccatctccttctcggcatcaagcttaccatggggatatggaagtggctagtgatggccagtttagtatggcctgttttgacactgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataaccagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16760 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (wt)
  source 1..3790: mol_type = other RNA
ggggcgctgcctacggaggtggcagccatctccttctcggcatcaagcttaccatggactggacctggatcctgttcctcgtggccgccgcgacccgcgtccacagcctgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataacaagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16761 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (wt)
  source 1..3790: mol_type = other RNA
ggggcgctgcctacggaggtggcagccatctccttctcggcatcaagcttaccatggactggacctggatcctgttcctcgtggccgccgcgacccgcgtccacagcctgagaaatgtctatgacatgaaaattgagtgcccccatacagtaagttttgggggaaacagtgtgataggttatgtagaattaccccccgtgccattggccgacacagcacagatggtgcctgagagttcttgtagcatggataatcaccaatcgttgaatacaataacaaaatatacccaagtaagttggagaggaaaggctgatcagtcacagtctagtcaaaattcatttgagacagtgtccactgaagttgacttgaaaggaacatgtgttctaaaacacaaaatggtggaagaatcataccgtagtaggaaatcagtaacctgttacgacctgtcttgcaatagcacttactgcaagccaacactatacatgattgtaccaattcatgcatgcaatatgatgaaaagctgtttgattgcattgggaccatacagagtacaggtggtttatgagagaacttactgtatgacaggagtcctgattgaagggaaatgctttgtcccagatcaaagtgtggtcagtattatcaagcatgggatctttgatattgcaagtgttcatattgtatgtttctttgttgcagttaaagggaatacttataaaatttttgaacaggttaagaaatcctttgaatcaacatgcaatgatacagagaataaagtgcaaggatattatatttgtattgtagggggaaactctgcaccaatatatgttccaacacttgatgatttcagatccatggaagcatttacaggaatcttcagatcaccacatggggaagatcatgatctggctggagaagaaattgcatcttattctatagtcggacctgccaatgcaaaagttcctcatagtgctagctcagatacattgagattgattgcctattcaggtataccatcttattcttcccttagcatcctaacaagttcaacagaagctaagcatgtattcagccctgggttgttcccaaaacttaatcacacaaattgtgataaaagtgccataccactcatatggactgggatgattgatttacctggatactacgaagctgtccacccttgtacagttttttgcgtattatcaggtcctggggcatcatgtgaagccttttctgaaggcgggattttcaacataacctcttccatgtgcttagtgtcaaaacaaaatcgattccggttaacagaacagcaagtgaattttgtgtgtcagcgagtggacatggacattgttgtgtactgcaacgggcagaggaaagtaatattaacaaaaactctagttattggacaatgtatatatactataaccagcttattctcattactacctggagtagcacattctattgctgttgaattgtgtgtacctgggttccatggttgggccacagctgctctgcttgttacattctgtttcggatgggttcttataccagcaattacatttatcatactaacagtcctaaagttcattgctaatatttttcacacaagtaaccaagagaataggctaaaatcagtacttagaaagataaaggaagagtttgaaaaaacaaaaggctcaatggtatgtgatgtctgcaagtatgagtgtgaaacctataaagaattaaaggcacacggggtatcatgcccccaatctcaatgtccttactgttttactcattgtgaacccacagaagcagcattccaagctcattacaaggtatgccaagttactcacagattcagggatgatctaaagaaaactgttactcctcaaaattttacaccaggatgttaccggacactaaatttatttagatacaaaagcaggtgctacatctttacaatgtggatatttcttcttgtcttagaatccatactgtgggctgcaagtgcatcagagacaccattaactcctgtctggaatgacaatgcccatggggtaggttctgttcctatgcatacagatttagagcttgatttctctttaacatccagttccaagtatacataccgtaggaagttaacaaacccacttgaggaagcacaatccattgacctacatattgaaatagaagaacagacaattggtgttgatgtgcatgctctaggacactggtttgatggtcgtcttaaccttaaaacatcctttcactgttatggtgcttgtacaaagtatgaatacccttggcatactgcaaagtgccactatgaaagagattaccaatatgagacgagctggggttgtaatccatcagattgtcctggggtgggcacaggctgtacagcatgtggtttatacctagatcaactgaaaccagttggtagtgcttataaaattatcacaataaggtacagcaggagagtctgtgttcagtttggggaggaaaacctttgtaagataatagacatgaatgattgttttgtatctaggcatgttaaggtctgcataattggtacagtatctaaattctctcagggtgataccttattgttttttggaccgcttgaaggtggtggtctaatatttaaacactggtgtacatccacatgtcaatttggtgacccaggagatatcatgagtccaagagacaaaggttttttatgccctgagtttccaggtagtttcaggaagaaatgcaactttgctactacccctatttgtgagtatgatggaaatatggtctcaggttacaagaaagtgatggcgacaattgattccttccaatcttttaatacaagcactatgcacttcactgatgaaaggatagagtggaaagaccctgatggaatgctaagggaccatataaacattttagtaacgaaggacattgactttgataaccttggtgaaaatccttgcaaaattggcctacaaacatcttctattgagggggcctggggttctggtgtggggttcacattaacatgtctggtatcactaacagaatgtcctacctttttgacctcaataaaggcttgtgataaggctatctgttatggtgcagagagtgtaacattgacaagaggacaaaatacagtcaaggtatcagggaaaggtggccatagtggttcaacatttaagtgttgccatggggaggactgttcacaaattggactccatgctgctgcacctcaccttgacaaggtaaatgggatttctgagatagaaaatagtaaagtatatgatgatggggcaccgcaatgtgggataaaatgttggtttgttaaatcaggggaatggatttcagggatattcagtggtaattggattgtactcattgtcctctgtgtatttctattgttctccttggttttactaagcattctctgtcccgtaaggaagcataaaaaatcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16762 - RNA, 1672 nt, synthetic construct
  misc_feature 1..1672: note = mRNA product Design2 comprising derived and/or modified sequence from HTNV(76-118/POR)__KT885049.1__N (opt4)
  source 1..1672: mol_type = other RNA
ggggcgctgcctacggaggtggcagccatctccttctcggcatcaagcttaccatggccaccatggaggagctgcagagagagatcaacgcccacgagggccagctggtgatcgccagacagaaggtgagagacgccgagaagcagtacgagaaggaccccgacgagctgaacaagagagccctgaccaacagagagggcgtggccgtgagcatccaggccaagatcgacgagctgaagatgcagctggccgacagaatcgccaccggcaagaacctgggcaaggagcaggaccccaccggcgtggagcccggcgaccacctgaaggagagaagcatgctgagctacggcaacgtgctggacctgaaccacctggacatcgacgagcccaccggccagaccgccgactggctgagcatcatcgtgtacctgaccagcttcgtggtgcccatcctgctgaaggccctgtacatgctgaccaccagaggcagacagaccaccaaggacaacaagggcaccagaatcagattcaaggacgacagcagcttcgaggacgtgaacggcatcagaaagcccaagcacctgtacgtgagcctgcccaacgcccagagcagcatgaaggccgaggagatcacccccggcagatacagaaccgccgtgtgcggcctgtaccccgcccagatcaaggccagacagatgatcagccccgtgatgagcgtgatcggcttcctggccctggccaaggactggagcgacagaatcgagcagtggctgatcgagccctgcaagctgctgcccgacaccgccgccgtgagcctgctgggcggccccgccaccaacagagactacctgagacagagacaggtggccctgggcaacatggagaccaaggagagcaaggccatcagacagcacgccgaggccgccggctgcagcatgatcgaggacatcgagagccccagcagcatctgggtgttcgccggcgcccccgacagatgcccccccacctgcctgttcatcgccggcatcgccgagctgggcgccttcttcagcatcctgcaggacatgagaaacaccatcatggccagcaagaccgtgggcaccagcgaggagaagctgagaaagaagagcagcttctaccagagctacctgagaagaacccagagcatgggcatccagctggaccagagaatcatcgtgctgttcatggtggcctggggcaaggaggccgtggacaacttccacctgggcgacgacatggaccccgagctgagaaccctggcccagagcctgatcgacgtgaaggtgaaggagatcagcaaccaggagcccctgaagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16763 - RNA, 3790 nt, synthetic construct
  misc_feature 1..3790: note = mRNA product Design2 comprising derived and/or modified sequence from HTNV(76-118/POR)__KT885048.1__GP (opt4)
  source 1..3790: mol_type = other RNA
ggggcgctgcctacggaggtggcagccatctccttctcggcatcaagcttaccatgggcatctggaagtggctggtgatggccagcctggtgtggcccgtgctgaccctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16764 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (opt4)
  source 1..3790: mol_type = other RNA
ggggcgctgcctacggaggtggcagccatctccttctcggcatcaagcttaccatggactggacctggatcctgttcctggtggccgccgccaccagagtgcacagcctgagaaacgtgtacgacatgaagatcgagtgcccccacaccgtgagcttcggcggcaacagcgtgatcggctacgtggagctgccccccgtgcccctggccgacaccgcccagatggtgcccgagagcagctgcagcatggacaaccaccagagcctgaacaccatcaccaagtacacccaggtgagctggagaggcaaggccgaccagagccagagcagccagaacagcttcgagaccgtgagcaccgaggtggacctgaagggcacctgcgtgctgaagcacaagatggtggaggagagctacagaagcagaaagagcgtgacctgctacgacctgagctgcaacagcacctactgcaagcccaccctgtacatgatcgtgcccatccacgcctgcaacatgatgaagagctgcctgatcgccctgggcccctacagagtgcaggtggtgtacgagagaacctactgcatgaccggcgtgctgatcgagggcaagtgcttcgtgcccgaccagagcgtggtgagcatcatcaagcacggcatcttcgacatcgccagcgtgcacatcgtgtgcttcttcgtggccgtgaagggcaacacctacaagatcttcgagcaggtgaagaagagcttcgagagcacctgcaacgacaccgagaacaaggtgcagggctactacatctgcatcgtgggcggcaacagcgcccccatctacgtgcccaccctggacgacttcagaagcatggaggccttcaccggcatcttcagaagcccccacggcgaggaccacgacctggccggcgaggagatcgccagctacagcatcgtgggccccgccaacgccaaggtgccccacagcgccagcagcgacaccctgagactgatcgcctacagcggcatccccagctacagcagcctgagcatcctgaccagcagcaccgaggccaagcacgtgttcagccccggcctgttccccaagctgaaccacaccaactgcgacaagagcgccatccccctgatctggaccggcatgatcgacctgcccggctactacgaggccgtgcacccctgcaccgtgttctgcgtgctgagcggccccggcgccagctgcgaggccttcagcgagggcggcatcttcaacatcaccagcagcatgtgcctggtgagcaagcagaacagattcagactgaccgagcagcaggtgaacttcgtgtgccagagagtggacatggacatcgtggtgtactgcaacggccagagaaaggtgatcctgaccaagaccctggtgatcggccagtgcatctacaccatcaccagcctgttcagcctgctgcccggcgtggcccacagcatcgccgtggagctgtgcgtgcccggcttccacggctgggccaccgccgccctgctggtgaccttctgcttcggctgggtgctgatccccgccatcaccttcatcatcctgaccgtgctgaagttcatcgccaacatcttccacaccagcaaccaggagaacagactgaagagcgtgctgagaaagatcaaggaggagttcgagaagaccaagggcagcatggtgtgcgacgtgtgcaagtacgagtgcgagacctacaaggagctgaaggcccacggcgtgagctgcccccagagccagtgcccctactgcttcacccactgcgagcccaccgaggccgccttccaggcccactacaaggtgtgccaggtgacccacagattcagagacgacctgaagaagaccgtgaccccccagaacttcacccccggctgctacagaaccctgaacctgttcagatacaagagcagatgctacatcttcaccatgtggatcttcctgctggtgctggagagcatcctgtgggccgccagcgccagcgagacccccctgacccccgtgtggaacgacaacgcccacggcgtgggcagcgtgcccatgcacaccgacctggagctggacttcagcctgaccagcagcagcaagtacacctacagaagaaagctgaccaaccccctggaggaggcccagagcatcgacctgcacatcgagatcgaggagcagaccatcggcgtggacgtgcacgccctgggccactggttcgacggcagactgaacctgaagaccagcttccactgctacggcgcctgcaccaagtacgagtacccctggcacaccgccaagtgccactacgagagagactaccagtacgagaccagctggggctgcaaccccagcgactgccccggcgtgggcaccggctgcaccgcctgcggcctgtacctggaccagctgaagcccgtgggcagcgcctacaagatcatcaccatcagatacagcagaagagtgtgcgtgcagttcggcgaggagaacctgtgcaagatcatcgacatgaacgactgcttcgtgagcagacacgtgaaggtgtgcatcatcggcaccgtgagcaagttcagccagggcgacaccctgctgttcttcggccccctggagggcggcggcctgatcttcaagcactggtgcaccagcacctgccagttcggcgaccccggcgacatcatgagccccagagacaagggcttcctgtgccccgagttccccggcagcttcagaaagaagtgcaacttcgccaccacccccatctgcgagtacgacggcaacatggtgagcggctacaagaaggtgatggccaccatcgacagcttccagagcttcaacaccagcaccatgcacttcaccgacgagagaatcgagtggaaggaccccgacggcatgctgagagaccacatcaacatcctggtgaccaaggacatcgacttcgacaacctgggcgagaacccctgcaagatcggcctgcagaccagcagcatcgagggcgcctggggcagcggcgtgggcttcaccctgacctgcctggtgagcctgaccgagtgccccaccttcctgaccagcatcaaggcctgcgacaaggccatctgctacggcgccgagagcgtgaccctgaccagaggccagaacaccgtgaaggtgagcggcaagggcggccacagcggcagcaccttcaagtgctgccacggcgaggactgcagccagatcggcctgcacgccgccgccccccacctggacaaggtgaacggcatcagcgagatcgagaacagcaaggtgtacgacgacggcgccccccagtgcggcatcaagtgctggttcgtgaagagcggcgagtggatcagcggcatcttcagcggcaactggatcgtgctgatcgtgctgtgcgtgttcctgctgttcagcctggtgctgctgagcatcctgtgccccgtgagaaagcacaagaagagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16765 - RNA, 1672 nt, synthetic construct
  misc_feature 1..1672: note = mRNA product Design2 comprising derived and/or modified sequence from HTNV(76-118/POR)__KT885049.1__N (opt3)
  source 1..1672: mol_type = other RNA
ggggcgctgcctacggaggtggcagccatctccttctcggcatcaagcttaccatggccaccatggaggaactgcagagagagatcaacgctcacgaaggccaactcgtgattgcaaggcagaaggtccgggacgccgagaaacagtacgaaaaggatcccgacgagcttaataaacgcgcgctgacaaaccgagagggggttgctgtgagcatacaggccaagatcgatgaattgaaaatgcaattagcagaccgtattgccactggaaagaatctgggtaaggagcaggatcctacgggcgtagaaccaggggaccatctaaaagagagatccatgctctcttatggaaacgtgctggatcttaatcacctggacatcgatgagccgaccggccagacagctgactggttgtcaattatcgtctacctcaccagtttcgtggttcccatactgctgaaggcactctatatgttaactacaaggggtcggcagaccactaaagataacaaggggacacgcatcagatttaaagacgatagctccttcgaagacgtgaatggaattaggaagcctaagcatctgtacgtctctcttccaaacgcccaatcgtcaatgaaagctgaggaaatcacccccggccggtatcgcacggccgtgtgcggcttgtaccctgcgcagattaaggcacgacagatgatcagcccagtaatgagtgttatagggtttctggccctagctaaagactggtccgatagaattgagcagtggctcatcgaaccctgtaagctgcttcctgacactgccgcagtgtctctgttgggaggtccagctaccaatagggattatctccggcaacgtcaggtcgccctgggcaacatggagacaaaagagagcaaggcgattcgccagcacgccgaagcagctgggtgctccatgatcgaggacatcgaatcaccgagtagcatttgggtgttcgccggagctcccgatagatgtcctccaacttgcttatttatagccggcatcgcagagctgggtgccttcttttctattctccaagacatgaggaataccatcatggcttccaaaacagtggggacctcagaagagaagctgcggaagaaaagcagtttctaccagtcttaccttcgacgcacgcagtccatgggaatacagttggatcaaagaattatcgtcctatttatggttgcgtggggcaaggaggcagtggacaacttccatctgggcgatgacatggatcccgaactcaggactctggcccagagccttatcgacgtaaaagtgaaggagatttcgaatcaggaacctctgaaattgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16766 - RNA, 3790 nt, synthetic construct
  misc_feature 1..3790: note = mRNA product Design2 comprising derived and/or modified sequence from HTNV(76-118/POR)__KT885048.1__GP (opt3)
  source 1..3790: mol_type = other RNA
ggggcgctgcctacggaggtggcagccatctccttctcggcatcaagcttaccatgggcatctggaagtggctggtgatggccagcctcgtctggcccgttcttaccctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcagtatcctgtgcccggtgcgaaaacacaaaaagagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16767 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (opt3)
  source 1..3790: mol_type = other RNA
ggggcgctgcctacggaggtggcagccatctccttctcggcatcaagcttaccatggactggacctggatcctgttcctcgtggccgctgcaacaagagtccacagcctgagaaacgtgtacgacatgaagattgagtgccctcacacagtatccttcgggggaaattctgtgataggttatgtcgaattgccaccggtgcccttagctgatactgcacagatggttcctgagtcaagttgtagcatggacaaccatcaatccctgaatacgatcaccaagtacacacaggtgtcttggaggggcaaagccgatcagtcgcagtcaagccaaaacagttttgaaactgtctccaccgaggtggacctaaaggggacatgcgtactcaaacacaagatggttgaagagtcttatcggagccgcaagtccgtgacctgttacgatctgtcatgcaatagtacttattgtaaaccaacactttacatgattgtccccatccatgcgtgcaacatgatgaaaagctgtctgattgctttgggaccttatcgagtccaggtggtgtacgagcgtacctactgcatgacgggcgttctcatcgaaggtaaatgtttcgtgccagaccagtctgtagtgtccataatcaagcacgggatttttgatatcgcctcagtccatattgtgtgcttctttgttgcagtgaaaggaaatacttataagatcttcgagcaggtcaagaaaagttttgaaagcacctgtaacgacacagagaataaggtgcaaggctactatatatgcattgtaggcgggaactctgcccccatctacgttcctactctggatgacttcagatccatggaggcttttaccggaattttcaggagcccacacggtgaagatcacgacctggcaggcgaggaaatcgcctcgtattctatcgtggggccggctaatgccaaagtcccccattccgcgtcaagtgatacactccggttaattgcatacagcggaataccttcctattctagcctgtcaatccttaccagttccacggaggccaagcacgtgtttagcccaggcttgttccccaaactgaaccatactaattgcgacaagtctgctattcctctaatctggacaggtatgatagacctcccagggtactacgaagccgtccacccctgtaccgtgttttgcgttctgtcaggaccgggcgcaagttgtgaggctttcagcgagggcgggattttcaacatcacttcctctatgtgccttgtgtcgaaacagaatcgctttagactgacagaacagcaggtaaacttcgtctgtcaaagggtggatatggacatcgttgtgtattgcaacggacagcggaaggtcattttgaccaagacgctcgtgatcggtcagtgtatttacaccataacaagcctgttttccttactgcctggcgtagcccactcaatcgcggtggagctctgcgttcccgggttccatggatgggccactgcagcccttctggtcaccttttgtttcggctgggtgttgattccagctatcacatttatcattctaactgtgctgaaattcatagctaatatctttcacaccagtaaccaagaaaatcgcctcaagtctgtcctgcgaaaaattaaggaggaatttgagaaaacaaagggtagcatggtttgcgatgtgtgtaagtatgagtgcgaaacctacaaagagcttaaggcccatggggtgtcctgccctcagtcacagtgtccctattgcttcactcactgtgaaccaacggaggcagccttccaggctcattacaaagtatgccaagtcacacacagatttagggacgatctgaagaaaaccgtgactccccagaacttcacccctggctgttatcggacattgaatctcttccgttacaagagccgctgctacatctttaccatgtggattttcctgttagttctggaatctatcctatgggcggcatccgccagtgagactccactcacaccggtgtggaacgacaatgctcacggagtcggcagcgtgcccatgcatacggatctggagcttgacttttctttgacctcctcaagtaagtatacttacagaaggaaactgacaaaccctctcgaagaggcccagagcatagatctgcacatcgaaattgaggagcagaccatcggggttgacgtgcatgcacttggacactggttcgatggtcggctgaatttgaagacatcgtttcactgttatggcgcctgcactaaatacgaatatccatggcataccgctaagtgtcactacgagcgagactatcaatacgaaacgtcctgggggtgcaacccctctgactgtcctggagtaggcaccggttgcacagcctgcgggctctacctggatcagttaaaaccagtcggcagcgcatataagattatcactatacgctactcaagaagggtgtgtgtgcagttcggagaggaaaatctgtgcaagattatcgacatgaacgattgttttgtcagtcggcatgttaaagtgtgcattatcggcaccgtatccaagttctctcagggggacacactactctttttcggacccctggagggtggcgggcttatatttaaacactggtgtactagcacgtgccaattcggagatccgggcgacatcatgtcccctcgcgataaggggtttttgtgtccagagttccccgggtcattcagaaagaagtgcaattttgcgaccacacctatttgtgaatatgacggcaacatggtgagcggatacaaaaaggtcatggctaccatcgatagtttccagtcttttaatacttccacaatgcatttcaccgacgagaggattgaatggaaggatcccgacggcatgctgcgtgatcacatcaacatactcgtgactaaagacattgactttgataacctgggggagaatccatgcaagatcggattacagaccagctcgatcgaaggcgcctggggttcaggggttggattcacactgacgtgtcttgtgtctttgaccgagtgccctacttttctcacaagtattaaagcatgcgacaaggccatctgttatggcgctgagtccgtcaccctgacacggggtcagaacactgtgaaagttagcggcaagggtggacactctggcagcaccttcaagtgctgtcatggggaagattgctcccaaattggactacacgccgcagctccccatctggacaaagtgaatggcatatcagagatcgaaaacagtaaggtctacgatgacggtgccccacagtgtgggattaaatgctggtttgtaaagagcggagagtggatctctggcattttctccggtaattggatcgtgctcatagttctgtgtgtgtttcttttgttctcactggtcttactcagtatcctgtgcccggtgcgaaaacacaaaaagagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16768 - RNA, 1672 nt, synthetic construct
  misc_feature 1..1672: note = mRNA product Design2 comprising derived and/or modified sequence from HTNV(76-118/POR)__KT885049.1__N (opt1)
  source 1..1672: mol_type = other RNA
ggggcgctgcctacggaggtggcagccatctccttctcggcatcaagcttaccatggccaccatggaggagctgcagcgcgagatcaacgcccacgagggccagctcgtgatcgcgcggcagaaggtccgcgacgccgagaagcagtacgagaaggaccccgacgagctgaacaagcgggccctgaccaaccgcgagggggtggccgtgagcatccaggccaagatcgacgagctcaagatgcagctggcggaccggatcgccacgggcaagaacctggggaaggagcaggaccccaccggcgtcgagcccggggaccacctcaaggagcgctccatgctgagctacggcaacgtgctggacctcaaccacctggacatcgacgagcccaccggccagaccgccgactggctgtccatcatcgtgtacctcacgagcttcgtcgtgcccatcctgctgaaggccctctacatgctgaccacccgggggcgccagaccacgaaggacaacaagggcacccggatccgcttcaaggacgactccagcttcgaggacgtgaacgggatccggaagccgaagcacctgtacgtctccctccccaacgcgcagagctccatgaaggccgaggagatcacccccggccgctaccggaccgccgtgtgcgggctgtaccccgcccagatcaaggcccgccagatgatcagcccggtgatgtccgtcatcggcttcctggcgctcgccaaggactggagcgaccggatcgagcagtggctgatcgagccctgcaagctgctccccgacacggccgccgtgtccctgctgggcgggcccgccaccaaccgcgactacctccggcagcgccaggtggcgctgggcaacatggagaccaaggagagcaaggccatccggcagcacgccgaggccgccgggtgctccatgatcgaggacatcgagagcccgtccagcatctgggtcttcgcgggcgcccccgaccgctgcccgccgacctgcctgttcatcgccggcatcgccgagctcggggccttcttctccatcctgcaggacatgcggaacacgatcatggcgagcaagaccgtgggcaccagcgaggagaagctgcgcaagaagtccagcttctaccagtcctacctccgccggacccagagcatggggatccagctggaccagcgcatcatcgtgctgttcatggtcgcctggggcaaggaggccgtggacaacttccacctcggggacgacatggaccccgagctgcggacgctggcccagtccctcatcgacgtgaaggtcaaggagatcagcaaccaggagcccctgaagctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16769 - RNA, 3790 nt, synthetic construct
  misc_feature 1..3790: note = mRNA product Design2 comprising derived and/or modified sequence from HTNV(76-118/POR)__KT885048.1__GP (opt1)
  source 1..3790: mol_type = other RNA
ggggcgctgcctacggaggtggcagccatctccttctcggcatcaagcttaccatgggcatctggaagtggctggtgatggccagcctcgtctggcccgtgctgaccctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcgcaagcacaagaagtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16770 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (opt1)
  source 1..3790: mol_type = other RNA
ggggcgctgcctacggaggtggcagccatctccttctcggcatcaagcttaccatggactggacctggatcctgttcctcgtggccgccgcgacccgcgtccacagcctgcgcaacgtgtacgacatgaagatcgagtgcccgcacaccgtctccttcgggggcaacagcgtgatcgggtacgtggagctcccgcccgtccccctggccgacacggcgcagatggtgcccgagtccagctgctccatggacaaccaccagagcctgaacaccatcaccaagtacacccaggtgtcctggcggggcaaggccgaccagagccagtccagccagaactccttcgagacggtcagcaccgaggtggacctcaaggggacctgcgtgctgaagcacaagatggtcgaggagtcctaccgcagccggaagtccgtgacctgctacgacctgagctgcaactccacgtactgcaagcccaccctctacatgatcgtgcccatccacgcctgcaacatgatgaagtcctgcctgatcgccctgggcccctaccgcgtccaggtggtgtacgagcggacctactgcatgaccggcgtcctcatcgaggggaagtgcttcgtgccggaccagtccgtggtcagcatcatcaagcacggcatcttcgacatcgccagcgtgcacatcgtgtgcttcttcgtcgcggtgaaggggaacacgtacaagatcttcgagcaggtcaagaagtccttcgagagcacgtgcaacgacaccgagaacaaggtgcagggctactacatctgcatcgtcgggggcaactccgcccccatctacgtgcccaccctggacgacttccgcagcatggaggccttcaccggcatcttccggagcccccacggggaggaccacgacctggccggcgaggagatcgcgagctactccatcgtggggccggccaacgccaaggtgccccacagcgcctccagcgacaccctccgcctgatcgcctactccggcatccccagctactccagcctgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtgcacccctgcaccgtgttctgcgtcctgagcgggccgggcgccagctgcgaggccttctccgagggcgggatcttcaacatcaccagctccatgtgcctcgtgagcaagcagaaccggttccgcctgacggagcagcaggtcaacttcgtgtgccagcgggtggacatggacatcgtggtctactgcaacggccagcgcaaggtgatcctgaccaagaccctcgtgatcgggcagtgcatctacaccatcacgtccctgttcagcctgctccccggcgtcgcgcactccatcgccgtggagctgtgcgtgcccgggttccacggctgggccaccgccgccctgctcgtcaccttctgcttcgggtgggtgctgatccccgcgatcaccttcatcatcctgacggtgctcaagttcatcgccaacatcttccacaccagcaaccaggagaaccggctgaagtccgtcctgcgcaagatcaaggaggagttcgagaagaccaagggcagcatggtgtgcgacgtgtgcaagtacgagtgcgagacctacaaggagctcaaggcccacggcgtctcctgcccgcagagccagtgcccctactgcttcacgcactgcgagcccaccgaggccgccttccaggcgcactacaaggtgtgccaggtgacccaccggttccgcgacgacctgaagaagaccgtcacgccccagaacttcaccccggggtgctaccggaccctgaacctcttccgctacaagtcccggtgctacatcttcaccatgtggatcttcctgctggtgctcgagagcatcctgtgggccgcctccgccagcgagacgcccctgacccccgtgtggaacgacaacgcgcacggcgtcgggtccgtgccgatgcacaccgacctcgagctggacttcagcctgaccagctccagcaagtacacctaccgccggaagctgacgaaccccctcgaggaggcccagtccatcgacctgcacatcgagatcgaggagcagaccatcggcgtggacgtccacgccctggggcactggttcgacggccgcctcaacctgaagaccagcttccactgctacggcgcctgcaccaagtacgagtacccctggcacacggccaagtgccactacgagcgcgactaccagtacgagacctcctgggggtgcaaccccagcgactgcccgggcgtggggaccggctgcaccgcgtgcggcctgtacctcgaccagctgaagcccgtggggtccgcctacaagatcatcacgatccggtacagccgccgggtctgcgtgcagttcggcgaggagaacctgtgcaagatcatcgacatgaacgactgcttcgtgtcccgccacgtcaaggtgtgcatcatcgggaccgtgagcaagttctcccagggcgacaccctcctgttcttcgggcccctggagggcggcgggctcatcttcaagcactggtgcaccagcacgtgccagttcggcgaccccggggacatcatgtccccgcgggacaagggcttcctgtgccccgagttccccgggagcttccgcaagaagtgcaacttcgccaccacccccatctgcgagtacgacggcaacatggtctccggctacaagaaggtgatggccaccatcgacagcttccagtccttcaacacgagcaccatgcacttcaccgacgagcggatcgagtggaaggacccggacgggatgctgcgcgaccacatcaacatcctcgtgaccaaggacatcgacttcgacaacctgggcgagaacccctgcaagatcgggctgcagacgtccagcatcgagggcgcctgggggagcggcgtcggcttcaccctgacctgcctcgtgtccctgaccgagtgccccacgttcctcaccagcatcaaggcgtgcgacaaggccatctgctacggggccgagtccgtgaccctgacccggggccagaacacggtcaaggtgagcgggaagggcgggcactccggcagcaccttcaagtgctgccacggcgaggactgctcccagatcgggctgcacgccgccgcgccccacctcgacaaggtcaacggcatcagcgagatcgagaactccaaggtgtacgacgacggggccccgcagtgcggcatcaagtgctggttcgtcaagagcggcgagtggatctccgggatcttcagcggcaactggatcgtgctgatcgtgctgtgcgtgttcctcctgttctccctggtcctcctgagcatcctgtgccccgtgcgcaagcacaagaagtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16771 - RNA, 1672 nt, synthetic construct
  misc_feature 1..1672: note = mRNA product Design2 comprising derived and/or modified sequence from HTNV(76-118/POR)__KT885049.1__N (opt5)
  source 1..1672: mol_type = other RNA
ggggcgctgcctacggaggtggcagccatctccttctcggcatcaagcttaccatggccaccatggaggaactgcagagagagatcaacgctcacgaaggccaactcgtgattgcccggcagaaggtccgcgacgcggagaaacagtacgaaaaggatcccgacgagctgaataaaagagctcttacaaaccgggagggggttgccgtgagcatccaggccaagattgatgaactgaaaatgcaactcgctgaccgcatcgccacgggaaagaatctgggcaaggagcaggatcctaccggggtggaaccgggagaccatcttaaagagagatccatgctgtcttatggcaacgtcctcgatctgaatcacctggacattgatgagcccacagggcagaccgctgactggctcagcatcatcgtgtacctgacatccttcgttgtgcctattcttctgaaggccctctatatgctgaccacacggggacgccagaccacgaaagataacaagggcaccagaatccggtttaaagacgattctagcttcgaagacgtcaatggcattcgcaagcccaagcatctttacgtgtccctgcctaacgcgcaatctagcatgaaagccgaggaaatcacacccgggagatatcggaccgctgtttgcggactctaccctgcccagattaaggctcgccagatgatctccccggtgatgagcgtcattggctttctggccctggcgaaagactggtctgatagaatcgagcagtggctcatcgaaccctgtaagctgcttcctgacacagccgctgtgtccctgctcgggggacccgccaccaatcgggattatctgcgccaaagacaggtggctcttggcaacatggagacgaaagagagcaaggccattcggcagcacgccgaagctgcggggtgctctatgatcgaggacattgaatcccctagctctatctgggtcttcgccggagctcccgatagatgtccgcctacatgcctgtttattgccggcatcgccgagctcggcgctttcttttccatcctgcaagacatgcgcaataccattatggccagcaaaacagttgggacctccgaagagaagctgcggaagaaatctagcttctaccagtcctacctcagacgcacccagagcatgggaatccagctggatcaacggattatcgtgctttttatggtggcgtggggcaaggaggctgtcgacaacttccatctgggggatgacatggatcccgaactcagaacactggcccagtctcttattgacgtgaaagttaaggagatctccaatcaggaacctctgaaactctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16772 - RNA, 3790 nt, synthetic construct
  misc_feature 1..3790: note = mRNA product Design2 comprising derived and/or modified sequence from HTNV(76-118/POR)__KT885048.1__GP (opt5)
  source 1..3790: mol_type = other RNA
ggggcgctgcctacggaggtggcagccatctccttctcggcatcaagcttaccatgggcatctggaagtggctggtgatggccagcctcgtctggcccgttctgacccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtcaagagcggggagtggatctccggaattttctctggcaattggatcgtgctcattgtgctgtgtgtttttcttctgttcagcctcgtgctgctgtccatcctttgccctgtccgcaaacacaaaaagagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16773 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (opt5)
  source 1..3790: mol_type = other RNA
ggggcgctgcctacggaggtggcagccatctccttctcggcatcaagcttaccatggactggacctggatcctgttcctcgtggccgctgccacaagagtccacagccttagaaacgtgtacgacatgaaaattgagtgccctcacacagtgtccttcgggggaaattctgtcatcggctatgtggaactgccgcccgttcctctcgctgatacggcccagatggtgcccgagagctcctgttctatggacaaccatcaaagcctgaataccattacaaagtacacccaggtctcctggcgggggaaagcggatcagtctcagagctcccaaaacagctttgaaacagtgtctaccgaggttgaccttaagggaacatgcgtgctgaaacacaagatggtcgaagagtcctatcgcagcagaaagtctgtgacctgttacgatctctcctgcaatagcacgtattgtaaacctaccctgtacatgatcgtgcccattcatgcttgcaacatgatgaagtcttgtctgatcgccctcggcccttatcgggtccaggttgtgtacgagcgcacatactgcatgaccggggtgctgatcgaaggaaaatgtttcgtcccggaccagtccgtggttagcattatcaagcacggcatttttgatatcgcctccgtgcatattgtctgcttctttgtggctgttaaaggcaatacatataagatcttcgaacaggtgaagaaatcttttgaaagcacctgtaacgacacggagaataaggtccaagggtactatatttgcatcgtgggaggcaactccgcccccatctacgtccctacacttgatgacttcagaagcatggaggcttttaccgggattttccggtctccccacggagaagatcacgacctggccggcgaggaaatcgcgtcctatagcattgtggggcctgccaatgctaaagttccccattctgccagctccgatacactccgcctgatcgcttactctgggattccgagctattccagcctttctatcctgacctccagcaccgaggccaagcacgtgttttctcctggcctcttccccaaactgaaccatacaaattgcgacaagtccgcgatccctctgatttggacgggcatgatcgacctccccgggtactacgaagccgtccacccctgtaccgtgttttgcgttctgagcggacctggcgcttcctgtgaggccttctctgagggaggaattttcaacatcacaagctccatgtgccttgtgtctaaacagaatagatttcggctgaccgaacagcaggtcaacttcgtgtgtcaacgcgtggatatggacattgttgtctattgcaacggccagagaaaggtgatcctcacaaagaccctggtgatcgggcagtgtatttacacgatcacaagcctgttttcccttctcccgggagtcgctcacagcattgccgtggagctgtgcgttcccggcttccatggctgggccaccgctgcgctgctcgtgaccttttgtttcgggtgggtcctgatccctgccattacatttatcattcttaccgtgctgaaattcatcgctaatatctttcacacatctaaccaagaaaatcggctcaagtccgttctgcgcaaaattaaggaggagttcgagaaaacgaagggaagcatggtgtgcgatgtctgtaagtatgagtgcgaaacctacaaagagcttaaggcccatggcgtgtcttgcccccagtcccagtgtccttattgctttacacactgtgaacccaccgaggccgctttccaggcccattacaaagtttgccaagtgacacacagatttcgggacgatctgaagaaaaccgtcacgccgcagaacttcacccctgggtgttatcgcacactcaatctgttcagatacaagagccggtgctacatctttaccatgtggattttcctgctcgtgctggaatctatcctttgggcggctagcgcctccgagacacccctgacccctgtgtggaacgacaatgcccacggagtcggcagcgttcccatgcatacggatctcgagctggacttttctctgacatccagctccaagtatacctacagacgcaaacttacaaaccctctcgaagaggctcagtctattgatctgcacatcgaaatcgaggagcagaccattggggtggacgtgcatgccctgggccactggttcgatggacggctcaatctgaagaccagctttcactgttatggcgcttgcacaaaatacgaatatccctggcatacggccaagtgtcactacgagagagactatcaatacgaaacctcctgggggtgcaacccgtctgactgtcctggagtcggcacagggtgcaccgcgtgcggactttacctggatcagctcaaacccgtgggcagcgcctataagatcattacaatccgctactcccggagagtttgtgtgcagttcggggaggaaaatctgtgcaagattatcgacatgaacgattgttttgtctctcgccatgtgaaagtttgcatcattggcaccgtgagcaagttctcccagggagacacgctgctctttttcggcccccttgaagggggaggcctgatctttaaacactggtgtacatctacctgccaattcggggatcctggagacattatgagcccgcgggataagggctttctgtgtcccgagttccctgggtccttcagaaagaagtgcaattttgctaccacacccatctgtgagtatgacggcaacatggtcagcggatacaaaaaggtgatggccaccattgattctttccagtcctttaatacaagcacgatgcatttcaccgacgagcgcatcgaatggaaggatcctgacggcatgctccgggatcacatcaacattctggttacaaaagacatcgactttgataaccttggggagaatccctgcaagattggactgcagacctcttccatcgaaggcgcttgggggagcggagtgggcttcacactcacctgtctggtctccctgacggagtgccctacctttcttacaagcattaaagcctgcgacaaggcgatctgttatggggccgagtctgtgaccctcacaagaggccagaacaccgtgaaagtcagcggaaagggcgggcactccggatctacattcaagtgctgtcatggcgaagattgcagccaaattgggctgcacgctgccgctccccatctggacaaagttaatggaatctccgagatcgaaaactctaaggtgtacgatgacggcgccccgcagtgtggcattaaatgctggtttgtcaagagcggggagtggatctccggaattttctctggcaattggatcgtgctcattgtgctgtgtgtttttcttctgttcagcctcgtgctgctgtccatcctttgccctgtccgcaaacacaaaaagagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16774 - RNA, 1672 nt, synthetic construct
  misc_feature 1..1672: note = mRNA product Design2 comprising derived and/or modified sequence from HTNV(76-118/POR)__KT885049.1__N (opt11)
  source 1..1672: mol_type = other RNA
ggggcgctgcctacggaggtggcagccatctccttctcggcatcaagcttaccatggccaccatggaggaactccaacgagagataaacgcccacgaaggccagctagtcatcgccagacaaaaagtccgagacgccgaaaaacaatacgaaaaagaccccgacgaactcaacaagagagccctaaccaaccgagaaggcgtcgcagtctccatccaagcaaaaatcgacgaactcaaaatgcaactagcagacagaatagctaccggcaaaaacctcggaaaagagcaagaccccacaggcgtagaacccggcgaccacctcaaagaaagatccatgctctcatacggcaacgtactagacctcaaccacctcgacatagacgaacccaccgggcaaacagccgactggctctccataatcgtctacctcacctccttcgtcgtcccaatcctcctcaaagcactatacatgctaaccacccggggcagacaaactaccaaagacaacaaaggcacccggatcagattcaaggacgacagctcattcgaagacgtgaacggcatccgaaaacccaaacacctttacgtctccctccccaacgcacaatcaagcatgaaagccgaagaaatcacgcctggccgctaccgaaccgcagtatgcggcctctaccccgcacaaatcaaagccagacaaatgatctcccccgtcatgtcagtaataggtttcctcgccctcgccaaagactggagcgaccgcatcgaacaatggctgatcgaaccatgcaaactcctccccgacacagccgcggtcagcctcctaggcggaccagccacaaacagagactacctcagacaacgccaagtcgccctcggcaacatggaaaccaaagaaagcaaagcaatacgacagcacgccgaagcggccggatgctccatgatcgaagacatagaaagcccaagctcaatatgggtcttcgccggcgcccccgaccgctgcccaccaacctgcctcttcatcgccggaatcgcagaacttggcgccttcttctctatcctccaagacatgcgcaacaccatcatggcaagcaaaacagtcggcaccagcgaggagaaactaagaaagaaatcctccttctaccaatcatacctcagacgcacccagtccatgggcatacaactcgaccaacgaatcatagtcctcttcatggtagcatggggcaaagaagcagtcgacaacttccacctaggcgatgacatggaccccgaactccgcaccctcgcccaaagcctcatcgacgtaaaagtcaaagaaatctccaaccaagaacccctcaaactctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16775 - RNA, 3790 nt, synthetic construct
  misc_feature 1..3790: note = mRNA product Design2 comprising derived and/or modified sequence from HTNV(76-118/POR)__KT885048.1__GP (opt11)
  source 1..3790: mol_type = other RNA
ggggcgctgcctacggaggtggcagccatctccttctcggcatcaagcttaccatgggcatctggaagtggctggtgatggcaagcctcgtctggcccgtgcttaccctgcgcaacgtgtatgacatgaagatcgagtgcccgcacacagtctccttcgggggtaacagcgttatcgggtacgtggagctcccgcccgtccccttggccgacacggcgcagatggtccccgagtcatcgtgctccatggacaaccaccagagcctgaacacaatcaccaagtacacccaggtgtcctggcggggcaaggcggaccagagccagtccagccagaactccttcgagacggtcagcacagaggtggacctcaaggggacctgtgtactgaagcacaagatggtcgaggagtcctaccgcagccggaagtccgtgacctgctacgacctgagctgcaactccacatactgcaagcccaccctctacatgatcgtgcccatccacgcctgcaacatgatgaagtcttgcctgatagcactgggcccctatcgcgtccaggtggtttacgagcggacgtactgcatgaccggcgtcctcatcgagggcaagtgcttcgtgccggaccagtccgtggtcagtatcatcaaacacggcatcttcgacatcgccagcgtgcacatcgtttgcttcttcgtcgctgttaagggaaacacgtacaagatcttcgagcaggtcaagaagtccttcgagagcacatgcaacgacaccgagaacaaggtgcaaggctactacatctgcatcgtcgggggcaactccgctcccatctacgtgcccaccctggacgacttccgcagcatggaggccttcacagggatcttccggagcccccacggggaggaccacgacctggccggcgaggagatcgcgagctactccatcgtggggccggccaacgccaaagtgccccacagcgccagcagcgacaccctccgcctgatagcctactccggcatccccagctactccagcttgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtccacccctgcacagtgttctgtgtcctgagcgggccaggcgcctcctgcgaggccttctccgagggcggaatcttcaacatcaccagctccatgtgcctcgtgtccaagcaaaaccggttccgcctgaccgagcaacaggtcaacttcgtgtgtcagcgggtggacatggacatcgtcgtctactgtaatggccagcgcaaggtgatcctgactaagaccctcgtgatcgggcagtgcatctacaccatcacgtccctgttcagcctgctccccggcgtagcgcactccatcgccgtggagctgtgcgtgcccgggttccacggctgggccacggcggccctgctcgtcaccttctgcttcgggtgggtgcttatccccgcgatcaccttcatcatcctgacggtgctcaagttcatcgccaacatcttccacacgagcaaccaggagaaccgtctgaagtccgtcctgcggaagatcaaggaggagttcgaaaagaccaagggctcaatggtgtgcgatgtgtgcaagtacgagtgcgagacctacaaagagctcaaggcccacggcgtatcctgcccgcagagtcagtgcccctactgcttcacgcattgcgagcccaccgaggccgccttccaggcgcactataaggtgtgtcaggtgacccaccggttccgcgacgacctgaagaagaccgtcacaccccagaacttcaccccgggctgctaccggaccctgaacctcttccgctacaagtcccggtgctacatcttcaccatgtggatcttcctgctggtgctcgaaagcatcctgtgggccgcctccgccagcgagacgcccttgacccccgtgtggaacgacaacgcgcacggcgtcgggtccgtgccgatgcacaccgacctcgagctggacttcagcctgactagctccagcaagtacacctaccggcgaaagctgacgaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcacgaagtatgagtatccctggcacacggccaagtgccactacgagcgcgactaccagtacgagacctcctggggatgcaaccccagcgattgtccgggcgtggggaccggctgtaccgcgtgcggcctgtacctcgaccagctgaagcccgtggggtccgcctacaagatcatcacgatccgatacagccgtagggtctgcgtgcagttcggcgaggagaatctgtgtaagatcatcgacatgaacgactgcttcgtgtcccgccacgtcaaggtgtgcatcatcgggaccgtgagcaagttttcccagggcgacacgctcctgttctttggccccctggagggcggcgggctcatctttaagcactggtgcaccagcacgtgccagtttggcgaccccggggacatcatgtccccgcgcgacaagggcttcctgtgccccgagttccccgggagcttccgcaagaaatgcaactttgcgaccacccctatctgcgagtacgacggcaacatggtctccggctacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacttgggcgagaatccctgcaagatcgggctgcagacctccagcatcgagggcgcctgggggagcggcgtcggcttcaccctaacctgcctcgtgtccctgaccgaatgtcccacgttcctcaccagcatcaaagcgtgcgataaggccatctgctacggggcggagtccgtgaccctgacccgaggccagaacacggtcaaggtgagcgggaagggcggacactccggcagcaccttcaagtgctgccacggcgaggactgctcccagatcgggctgcacgccgcggcgccccacctcgacaaggtcaacggcatctcagaaatcgagaactccaaggtgtacgacgatggggcacctcagtgtggcatcaaatgctggttcgtcaagagcggcgagtggatctccgggatcttcagcggcaactggatcgtgttgattgtcctgtgcgtgttcctcctgttctccctggtcctcctgagcatcctgtgccccgtgcgcaagcacaagaaatcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16776 - RNA, 3790 nt, synthetic construct
  misc_feature 1..3790: note = mRNA product Design2 comprising derived and/or modified sequence from HTNV(76-118/POR)__KT885048.1__IgE-leader_Gn-Gc (opt11)
  source 1..3790: mol_type = other RNA
ggggcgctgcctacggaggtggcagccatctccttctcggcatcaagcttaccatggattggacgtggatactctttctcgtggccgcggccacgcgcgtgcactcgctgcgcaacgtgtatgacatgaagatcgagtgcccgcacacagtctccttcgggggtaacagcgttatcgggtacgtggagctcccgcccgtccccttggccgacacggcgcagatggtccccgagtcatcgtgctccatggacaaccaccagagcctgaacacaatcaccaagtacacccaggtgtcctggcggggcaaggcggaccagagccagtccagccagaactccttcgagacggtcagcacagaggtggacctcaaggggacctgtgtactgaagcacaagatggtcgaggagtcctaccgcagccggaagtccgtgacctgctacgacctgagctgcaactccacatactgcaagcccaccctctacatgatcgtgcccatccacgcctgcaacatgatgaagtcttgcctgatagcactgggcccctatcgcgtccaggtggtttacgagcggacgtactgcatgaccggcgtcctcatcgagggcaagtgcttcgtgccggaccagtccgtggtcagtatcatcaaacacggcatcttcgacatcgccagcgtgcacatcgtttgcttcttcgtcgctgttaagggaaacacgtacaagatcttcgagcaggtcaagaagtccttcgagagcacatgcaacgacaccgagaacaaggtgcaaggctactacatctgcatcgtcgggggcaactccgctcccatctacgtgcccaccctggacgacttccgcagcatggaggccttcacagggatcttccggagcccccacggggaggaccacgacctggccggcgaggagatcgcgagctactccatcgtggggccggccaacgccaaagtgccccacagcgccagcagcgacaccctccgcctgatagcctactccggcatccccagctactccagcttgtccatcctcaccagctccaccgaggcgaagcacgtcttcagccccggcctgttcccgaagctgaaccacacgaactgcgacaagtccgccatccccctcatctggaccgggatgatcgacctgcccggctactacgaggccgtccacccctgcacagtgttctgtgtcctgagcgggccaggcgcctcctgcgaggccttctccgagggcggaatcttcaacatcaccagctccatgtgcctcgtgtccaagcaaaaccggttccgcctgaccgagcaacaggtcaacttcgtgtgtcagcgggtggacatggacatcgtcgtctactgtaatggccagcgcaaggtgatcctgactaagaccctcgtgatcgggcagtgcatctacaccatcacgtccctgttcagcctgctccccggcgtagcgcactccatcgccgtggagctgtgcgtgcccgggttccacggctgggccacggcggccctgctcgtcaccttctgcttcgggtgggtgcttatccccgcgatcaccttcatcatcctgacggtgctcaagttcatcgccaacatcttccacacgagcaaccaggagaaccgtctgaagtccgtcctgcggaagatcaaggaggagttcgaaaagaccaagggctcaatggtgtgcgatgtgtgcaagtacgagtgcgagacctacaaagagctcaaggcccacggcgtatcctgcccgcagagtcagtgcccctactgcttcacgcattgcgagcccaccgaggccgccttccaggcgcactataaggtgtgtcaggtgacccaccggttccgcgacgacctgaagaagaccgtcacaccccagaacttcaccccgggctgctaccggaccctgaacctcttccgctacaagtcccggtgctacatcttcaccatgtggatcttcctgctggtgctcgaaagcatcctgtgggccgcctccgccagcgagacgcccttgacccccgtgtggaacgacaacgcgcacggcgtcgggtccgtgccgatgcacaccgacctcgagctggacttcagcctgactagctccagcaagtacacctaccggcgaaagctgacgaaccccctcgaggaggcccagtccatcgacctgcacatcgagatcgaggagcagacgatcggcgtggacgtccacgccctggggcactggttcgacggccggctcaacctgaagaccagcttccactgctacggcgcctgcacgaagtatgagtatccctggcacacggccaagtgccactacgagcgcgactaccagtacgagacctcctggggatgcaaccccagcgattgtccgggcgtggggaccggctgtaccgcgtgcggcctgtacctcgaccagctgaagcccgtggggtccgcctacaagatcatcacgatccgatacagccgtagggtctgcgtgcagttcggcgaggagaatctgtgtaagatcatcgacatgaacgactgcttcgtgtcccgccacgtcaaggtgtgcatcatcgggaccgtgagcaagttttcccagggcgacacgctcctgttctttggccccctggagggcggcgggctcatctttaagcactggtgcaccagcacgtgccagtttggcgaccccggggacatcatgtccccgcgcgacaagggcttcctgtgccccgagttccccgggagcttccgcaagaaatgcaactttgcgaccacccctatctgcgagtacgacggcaacatggtctccggctacaagaaggtgatggccaccatcgacagcttccagtccttcaacacgagcaccatgcacttcaccgacgagcggatcgagtggaaggacccggacggcatgctgcgcgaccacatcaacatcctcgtgaccaaggacatcgacttcgacaacttgggcgagaatccctgcaagatcgggctgcagacctccagcatcgagggcgcctgggggagcggcgtcggcttcaccctaacctgcctcgtgtccctgaccgaatgtcccacgttcctcaccagcatcaaagcgtgcgataaggccatctgctacggggcggagtccgtgaccctgacccgaggccagaacacggtcaaggtgagcgggaagggcggacactccggcagcaccttcaagtgctgccacggcgaggactgctcccagatcgggctgcacgccgcggcgccccacctcgacaaggtcaacggcatctcagaaatcgagaactccaaggtgtacgacgatggggcacctcagtgtggcatcaaatgctggttcgtcaagagcggcgagtggatctccgggatcttcagcggcaactggatcgtgttgattgtcctgtgcgtgttcctcctgttctccctggtcctcctgagcatcctgtgccccgtgcgcaagcacaagaaatcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16777 - protein, 433 aa, synthetic construct; identical to SEQ ID NO: 379
  REGION 1..433: note = derived and/or modified protein sequence (wt) from PUUV(K27)__L08804.1__N

SEQ ID NO: 16778 - protein, 1148 aa, synthetic construct; identical to SEQ ID NO: 1060
  REGION 1..1148: note = derived and/or modified protein sequence (wt) from PUUV(K27)__L08754.1__GP

SEQ ID NO: 16779 - protein, 1143 aa, synthetic construct
  REGION 1..1143: note = derived and/or modified protein sequence (wt) from PUUV(K27)__L08754.1__IgE-leader_Gn-Gc
MDWTWILFLVAAATRVHSARNLNELKMECPHTIRLGQGLVVGSVELPSLPIQQVETLKLESSCNFDLHTSTAGQQSFTKWTWEIKGDLAENTQASSTSFQTKSSEVNLRGLCLIPTLVVETAARMRKTIACYDLSCNQTVCQPTVYLMGPIQTCITTKSCLLSLGDQRIQVNYEKTYCVSGQLVEGICFNPIHTMALSQPSHTYDIMTMMVRCFLVIKKVTSGDSMKIEKNFETLVQKNGCTANNFQGYYICLIGSSSEPLYVPALDDYRSAEVLSRMAFAPHGEDHDIEKNAVSAMRIAGKVTGKAPSTESSDTVQGIAFSGSPLYTSTGVLTSKDDPVYIWAPGIIMEGNHSICEKKTLPLTWTGFISLPGEIEKTTQCTVFCTLAGPGADCEAYSETGIFNISSPTCSINRVQRFRGSEQQIKFVCQRVDMDITVYCNGMKKVILTKTLVIGQCIYTFTSIFSLIPGVAHSLAVELCVPGLHGWATMLLLLTLCFGWVLIPTITMILLKILIAFAYLCSKYNTDSKFRILIEKVKREYQKTMGSMVCEVCQYECETAKELESHRKSCSIGSCPYCLNPSEATTSALQAHFKVCKLTSRFQENLRKSLTVYEPMQGCYRTLSLFRYRSRFFVGLVWCVLLVLELIVWAASAETQNLNAGWTDTAHGSGIIPMKTDLELDFSLPSSASYTYRRQLQNPANEQEKIPFHLQLSKQVIHAEIQHLGHWMDATFNLKTAFHCYGSCEKYAYPWQTAGCFIEKDYEYETGWGCNPPDCPGVGTGCTACGVYLDKLKSVGKVFKIVSLRYTRKVCIQLGTEQTCKTVDSNDCLITTSVKVCLIGTISKFQPSDTLLFLGPLQQGGLIFKQWCTTTCQFGDPGDIMSTPTGMKCPELNGSFRKKCAFATTPVCQFDGNTISGYKRMIATKDSFQSFNVTEPHISTSALEWIDPDSSLRDHINVIVSRDLSFQDLSETPCQIDLATASIDGAWGSGVGFNLVCTVSLTECSAFLTSIKACDAAMCYGSTTANLVRGQNTIHIVGKGGHSGSKFMCCHDTKCSSTGLVAAAPHLDRVTGYNQADSDKIFDDGAPECGMSCWFKKSGEWILGVLNGNWMVVAVLVVLLILSILLFTLCCPRRPSYRKEHKP

SEQ ID NO: 16780 - RNA, 1302 nt, synthetic construct; identical to SEQ ID NO: 2714
  misc_feature 1..1302: note = derived and/or modified CDS sequence (wt) from PUUV(K27)__L08804.1__N
  source 1..1302: mol_type = other RNA

SEQ ID NO: 16781 - RNA, 3447 nt, synthetic construct; identical to SEQ ID NO: 3395
  misc_feature 1..3447: note = derived and/or modified CDS sequence (wt) from PUUV(K27)__L08754.1__GP
  source 1..3447: mol_type = other RNA

SEQ ID NO: 16782 - RNA, 3447 nt, synthetic construct
  misc_feature 1..3447: note = derived and/or modified CDS sequence (wt) from PUUV(K27)__L08754.1__GP
  source 1..3447: mol_type = other RNA
atgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcatactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttacaagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 16783 - RNA, 3432 nt, synthetic construct
  misc_feature 1..3432: note = derived and/or modified CDS sequence (wt) from PUUV(K27)__L08754.1__IgE-leader_Gn-Gc
  source 1..3432: mol_type = other RNA
atggactggacctggatcctgttcctcgtggccgccgcgacccgcgtccacagcgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 16784 - RNA, 3432 nt, synthetic construct
  misc_feature 1..3432: note = derived and/or modified CDS sequence (wt) from PUUV(K27)__L08754.1__IgE-leader_Gn-Gc
  source 1..3432: mol_type = other RNA
atggactggacctggatcctgttcctcgtggccgccgcgacccgcgtccacagcgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcatactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttacaagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaa

SEQ ID NO: 16785 - RNA, 1302 nt, synthetic construct; identical to SEQ ID NO: 5049
  misc_feature 1..1302: note = derived and/or modified CDS sequence (opt4) from PUUV(K27)__L08804.1__N
  source 1..1302: mol_type = other RNA

SEQ ID NO: 16786 - RNA, 3447 nt, synthetic construct; identical to SEQ ID NO: 8498
  misc_feature 1..3447: note = derived and/or modified CDS sequence (opt4) from PUUV(K27)__L08754.1__GP
  source 1..3447: mol_type = other RNA

SEQ ID NO: 16787 - RNA, 3432 nt, synthetic construct
  misc_feature 1..3432: note = derived and/or modified CDS sequence (opt4) from PUUV(K27)__L08754.1__IgE-leader_Gn-Gc
  source 1..3432: mol_type = other RNA
atggactggacctggatcctgttcctggtggccgccgccaccagagtgcacagcgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcagcatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccctgtgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctga

SEQ ID NO: 16788 - RNA, 1302 nt, synthetic construct; identical to SEQ ID NO: 5741
  misc_feature 1..1302: note = derived and/or modified CDS sequence (opt3) from PUUV(K27)__L08804.1__N
  source 1..1302: mol_type = other RNA

SEQ ID NO: 16789 - RNA, 3447 nt, synthetic construct; identical to SEQ ID NO: 10141
  misc_feature 1..3447: note = derived and/or modified CDS sequence (opt3) from PUUV(K27)__L08754.1__GP
  source 1..3447: mol_type = other RNA

SEQ ID NO: 16790 - RNA, 3432 nt, synthetic construct
  misc_feature 1..3432: note = derived and/or modified CDS sequence (opt3) from PUUV(K27)__L08754.1__IgE-leader_Gn-Gc
  source 1..3432: mol_type = other RNA
atggactggacctggatcctgttcctcgtggccgctgcaacaagagtccacagcgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgctccattaacagagttcagaggttccggggaagcgagcaacagatcaagtttgtgtgtcagcgcgtcgacatggacatcacagtgtactgcaacggcatgaaaaaggtaattctgaccaagactttggttatcggtcagtgtatttataccttcacatctatattctcactcatccccggggtggcccacagtctggcagtcgagttatgcgtgccgggcctgcatggatgggctaccatgctactcctgcttactttgtgttttggctgggtcctgattcctacaatcacgatgatcctcctgaaaattcttatagccttcgcttacctgtgcagcaagtataataccgattccaaatttcgaatcttgattgaaaaggtgaaaagagagtaccaaaagactatggggtctatggtttgcgaagtgtgtcagtacgagtgcgaaacagccaaggagctcgagtcgcacaggaaaagctgttccatcggatcatgcccctattgtctgaacccaagtgaagcaaccacatctgccttacaggctcatttcaaggtatgcaaactgactagccggtttcaggagaatctacgtaagtccctcaccgtctacgaacctatgcaaggttgttatcgcacgctgtcacttttcagatacaggagccggtttttcgtgggcttggtttggtgcgtgctgctcgtcctggagttaattgtgtgggcggcatctgccgagacccagaacctgaatgctgggtggacagacactgcccacggatccggcatcatacccatgaaaaccgatcttgaattggactttagtctcccaagctctgcatcctatacataccgacgccagctgcagaaccccgccaatgagcaagaaaagatccctttccacctacagctgtcaaagcaggtaattcatgctgagatccaacacctcggtcattggatggatgccacttttaacctgaaaaccgcattccactgttatgggagttgcgaaaagtacgcgtacccatggcagacggctggctgttttattgagaaagactatgagtacgaaacaggatggggctgcaatccgcccgattgccctggggtgggaaccggttgtactgcctgcggcgtttatcttgacaagttgaaaagcgtcgggaaggtgttcaagatcgtgtcgctgagatacacaaggaaagtctgtatacagttaggaaccgagcagacttgcaagaccgttgattccaacgactgtctcattacaacgtctgtgaaagtgtgcctgatcggcaccattagcaagttccaaccatcagatactcttctgtttttgggtcccctccagcaagggggcctgatcttcaaacagtggtgtacaaccacatgccagtttggagaccctggcgacataatgagtactccaaccgggatgaagtgtcccgaactaaatggatccttccggaaaaagtgcgcatttgccacgacaccggtatgtcagttcgatggcaacaccatctctggttataagcgcatgattgctactaaagacagctttcagtccttcaatgtcaccgagcctcatatctcaacaagcgccctggaatggattgatccagacagttctctcagagatcacatcaacgtgatagtttccagggacctgagctttcaggatctttcggagactccctgccaaattgacttggcaaccgcttcaatcgatggggcctggggatctggcgtgggtttcaatctggtctgcacagtgagtttaacggagtgttccgcgtttctcaccagcatcaaggcctgcgacgctgcaatgtgttacggctctactacagccaacctggttcgtgggcagaacaccattcacatcgtgggaaaaggcgggcatagcggatccaagttcatgtgctgtcacgatactaaatgctcaagtacaggccttgtagctgccgcacctcatctggaccgggtcaccggttataatcaggcggatagcgacaagatttttgacgatggggcccccgaatgtggaatgtcttgctggttcaagaaatccggcgagtggatactaggtgtgctcaacggcaattggatggtggtcgctgttctggtggtattgctgatcttatcaattctcctgttcacgctttgttgcccacgaagacctagttacaggaaggaacacaaaccctga

SEQ ID NO: 16791 - RNA, 1302 nt, synthetic construct; identical to SEQ ID NO: 6433
  misc_feature 1..1302: note = derived and/or modified CDS sequence (opt1) from PUUV(K27)__L08804.1__N
  source 1..1302: mol_type = other RNA

SEQ ID NO: 16792 - RNA, 3447 nt, synthetic construct; identical to SEQ ID NO: 11784
  misc_feature 1..3447: note = derived and/or modified CDS sequence (opt1) from PUUV(K27)__L08754.1__GP
  source 1..3447: mol_type = other RNA

SEQ ID NO: 16793 - RNA, 3432 nt, synthetic construct
  misc_feature 1..3432: note = derived and/or modified CDS sequence (opt1) from PUUV(K27)__L08754.1__IgE-leader_Gn-Gc
  source 1..3432: mol_type = other RNA
atggactggacctggatcctgttcctcgtggccgccgcgacccgcgtccacagcgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgctccatcaaccgcgtccagcggttccgcggcagcgagcagcagatcaagttcgtgtgccagcgggtcgacatggacatcaccgtgtactgcaacgggatgaagaaggtgatcctgaccaagaccctggtcatcggccagtgcatctacacgttcacctccatcttcagcctcatccccggcgtggcccacagcctggccgtggagctgtgcgtccccgggctccacggctgggccaccatgctgctgctcctgaccctgtgcttcgggtgggtgctgatccccacgatcaccatgatcctcctgaagatcctgatcgcgttcgcctacctctgctccaagtacaacaccgacagcaagttccgcatcctgatcgagaaggtgaagcgggagtaccagaagaccatgggctccatggtctgcgaggtgtgccagtacgagtgcgagacggccaaggagctggagagccaccgcaagtcctgcagcatcgggtcctgcccctactgcctcaaccccagcgaggccaccacctccgccctgcaggcgcacttcaaggtgtgcaagctgaccagccggttccaggagaacctccgcaagtccctgacggtctacgagccgatgcagggctgctaccggaccctgagcctcttccgctaccggtcccgcttcttcgtgggcctggtgtggtgcgtcctgctcgtgctggagctgatcgtgtgggccgccagcgccgagacccagaacctcaacgcggggtggaccgacacggcccacggctccgggatcatccccatgaagaccgacctggagctggacttcagcctcccctccagcgccagctacacctaccgccggcagctgcagaaccccgccaacgagcaggagaagatcccgttccacctccagctctccaagcaggtcatccacgccgagatccagcacctgggccactggatggacgcgaccttcaacctgaagacggccttccactgctacggcagctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctgaagtccgtcgggaaggtgttcaagatcgtgagcctgcgctacacccggaaggtctgcatccagctcggcaccgagcagacctgcaagacggtggactccaacgactgcctgatcaccaccagcgtgaaggtctgcctgatcgggaccatctccaagttccagcccagcgacacgctcctgttcctgggccccctccagcagggcgggctgatcttcaagcagtggtgcaccacgacctgccagttcggcgacccgggggacatcatgtccacccccaccggcatgaagtgccccgagctgaacgggagcttccgcaagaagtgcgcgttcgccaccacccccgtgtgccagttcgacggcaacaccatctccgggtacaagcggatgatcgccacgaaggacagcttccagtccttcaacgtgaccgagccgcacatcagcacctccgccctcgagtggatcgaccccgacagctccctgcgcgaccacatcaacgtcatcgtgagccgggacctgtccttccaggacctcagcgagaccccctgccagatcgacctggccacggcgagcatcgacggcgcctggggctccggggtgggcttcaacctggtctgcaccgtgagcctcaccgagtgctccgccttcctgaccagcatcaaggcctgcgacgcggccatgtgctacgggtccacgaccgccaacctggtgcgcggccagaacaccatccacatcgtcgggaagggcggccacagcgggtccaagttcatgtgctgccacgacaccaagtgcagctccacgggcctcgtggccgccgcgccccacctggaccgggtgaccgggtacaaccaggccgacagcgacaagatcttcgacgacggcgccccggagtgcggcatgtcctgctggttcaagaagtccggggagtggatcctgggcgtcctcaacgggaactggatggtggtggccgtcctggtggtgctgctcatcctgagcatcctgctgttcaccctgtgctgcccccgccggcccagctaccgcaaggagcacaagccctga

SEQ ID NO: 16794 - RNA, 1302 nt, synthetic construct; identical to SEQ ID NO: 7125
  misc_feature 1..1302: note = derived and/or modified CDS sequence (opt5) from PUUV(K27)__L08804.1__N
  source 1..1302: mol_type = other RNA

SEQ ID NO: 16795 - RNA, 3447 nt, synthetic construct; identical to SEQ ID NO: 13427
  misc_feature 1..3447: note = derived and/or modified CDS sequence (opt5) from PUUV(K27)__L08754.1__GP
  source 1..3447: mol_type = other RNA

SEQ ID NO: 16796 - RNA, 3432 nt, synthetic construct
  misc_feature 1..3432: note = derived and/or modified CDS sequence (opt5) from PUUV(K27)__L08754.1__IgE-leader_Gn-Gc
  source 1..3432: mol_type = other RNA
atggactggacctggatcctgttcctcgtggccgctgccacaagagtccacagcgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccctacctgcagcattaaccgggtgcagcgcttcagaggctctgagcaacagatcaagtttgtttgtcagcgggtggacatggacattacagtctactgcaacgggatgaaaaaggtgatcctgaccaagacgctcgtcatcggacagtgtatttataccttcacatccatcttcagcctgattcccggcgtggcccactccctggctgttgagctctgcgtgcccgggctgcatggatgggcgaccatgcttctgctcctgacactgtgttttggctgggtccttatcccgaccattacgatgatcctcctgaaaattctgatcgccttcgcttacctctgctctaagtataatacagatagcaaatttcgcatcctgattgaaaaggtgaaaagagagtaccaaaagaccatggggtccatggtttgcgaagtgtgtcagtacgagtgcgaaacagccaaggagcttgagtctcaccggaaaagctgttccatcggcagctgcccctattgtctgaacccttctgaagccaccacctccgctctccaggcccatttcaaggtctgcaaactgacaagccgctttcaggagaatctgagaaagtctcttacggtgtacgaacccatgcaaggatgttatcggaccctctccctgttcagataccgcagccggtttttcgtgggcctggtttggtgcgtcctcctggtgcttgagctgattgtgtgggcggcttctgccgagacacagaacctcaatgccgggtggaccgacacagctcacggaagcggcatcattcctatgaaaaccgatctggaactggacttttcccttcccagctctgcctcctatacgtacagacgccagctccagaacccggctaatgagcaagaaaagatccctttccatctgcagctgagcaagcaggtcatccacgccgagattcaacacctcgggcattggatggatgcgacatttaacctgaaaaccgccttccactgttatggatcctgcgaaaagtacgcttacccctggcagaccgccggctgttttatcgagaaagactatgagtacgaaacagggtggggctgcaatcctcccgattgccctggagtgggcaccgggtgtacagcttgcggagtttatcttgacaagctgaaatctgtgggcaaggtcttcaagattgtgagcctccggtacacgagaaaagtttgtatccagctggggaccgagcagacatgcaagaccgtggattccaacgactgtctgattacaacctctgtcaaagtgtgccttatcggaacgatcagcaagttccaaccctccgataccctcctgtttctgggcccgctccagcagggaggcctgattttcaaacagtggtgtacaaccacatgccaatttggagaccctggcgacatcatgtctacccccacagggatgaagtgtcccgaacttaatgggagcttccgcaaaaagtgcgcctttgcgaccacgcctgtttgtcagttcgatggcaacacaatttccgggtataagcggatgatcgccaccaaagacagctttcagtctttcaatgtgaccgagccgcatatttccacaagcgctctggaatggatcgatcccgactcttccctcagagatcacatcaacgtcattgtgagccgcgacctgtcttttcaggatctgtccgagaccccttgccaaatcgaccttgccacggctagcattgatggagcctggggctccggggtgggcttcaatctggtctgcacagttagcctcaccgagtgttctgcctttctgacaagcatcaaggcttgcgacgcggccatgtgttacggatccaccacagctaacctcgtgcggggccagaacaccattcacatcgtggggaaaggaggccattctgggagcaagttcatgtgctgtcacgatacgaaatgctcctctaccggactggtcgccgccgctccccatcttgacagagtgacaggctataatcaggccgatagcgacaagatttttgacgatggcgcgcctgaatgtgggatgtcctgctggttcaagaaatctggagagtggatcctgggcgttctcaacgggaattggatggtggtcgctgtgctggttgtgctgcttatcctgagcattctcctgttcaccctctgttgcccccgccggccttcctacagaaaggaacacaaaccctga

SEQ ID NO: 16797 - RNA, 1302 nt, synthetic construct; identical to SEQ ID NO: 7817
  misc_feature 1..1302: note = derived and/or modified CDS sequence (opt11) from PUUV(K27)__L08804.1__N
  source 1..1302: mol_type = other RNA

SEQ ID NO: 16798 - RNA, 3447 nt, synthetic construct; identical to SEQ ID NO: 15070
  misc_feature 1..3447: note = derived and/or modified CDS sequence (opt11) from PUUV(K27)__L08754.1__GP
  source 1..3447: mol_type = other RNA

SEQ ID NO: 16799 - RNA, 3432 nt, synthetic construct
  misc_feature 1..3432: note = derived and/or modified CDS sequence (opt11) from PUUV(K27)__L08754.1__IgE-leader_Gn-Gc
  source 1..3432: mol_type = other RNA
atggattggacgtggatactctttctcgtggccgcggccacgcgcgtgcactcggcccgcaatctaaacgaactcaaaatggaatgcccccacacaatccgactcggacaaggcctagtcgtcggatccgtagaactacccagcctccccatccaacaagtcgagacactcaaactcgaatccagttgcaatttcgacctccataccagcaccgccggccagcaatccttcacaaaatggacctgggaaataaaaggcgacctcgcggagaacacacaagcctctagcacatctttccaaaccaaaagcagcgaagttaacctccgaggcctgtgccttatccccaccctcgttgtcgaaaccgcagcacgcatgcgcaaaaccatagcatgctacgacctcagctgcaaccaaacagtctgccaaccaacagtctacctaatgggccctattcaaacatgcatcacaaccaaaagctgcctcctcagcctcggcgaccaaagaatacaagtaaactacgagaaaacgtactgcgtatctggtcagctcgtcgaaggcatctgcttcaaccccatacacacaatggcactttcacaaccctcacacacttacgacatcatgaccatgatggtccgatgcttcctggtgatcaagaaagttacctcaggtgacagcatgaaaatagagaaaaacttcgaaacactcgtccagaaaaacggctgcaccgccaacaacttccaaggatactatatctgcctgataggatcatcatcagaaccgctgtacgtcccggccctagacgactaccgatctgccgaagttctttctcgcatggccttcgcaccacacggcgaagatcacgacatagagaaaaacgcagtcagcgcaatgaggatcgcaggcaaagtaacgggcaaagctcccagcacagaaagctctgataccgtacaggggatcgcattcagcggcagcccactttacacctccactggcgtattaacaagcaaggacgaccccgtgtacatctgggccccaggcattatcatggaaggtaaccactccatatgtgaaaagaaaaccttgccgctcacttggaccggatttatctctctccccggcgaaatcgagaaaacgacccaatgcacagtcttttgtaccctagcaggaccaggcgccgactgcgaagcatacagcgaaaccggcatcttcaacattagcagccctacttgctccatcaaccgcgttcaacggttccgaggctcggaacagcaaataaaattcgtctgccaacgcgtagacatggacataaccgtctactgcaacgggatgaagaaagtcattcttaccaaaaccctagtgatagggcaatgtatatataccttcacatctatcttctcactcatcccaggagttgcacattccctcgccgtcgaactctgtgtacccggcctacatggctgggccaccatgctcctactactcaccctatgcttcggctgggtcctaatacccaccataaccatgatccttctaaaaatactcatagctttcgcctacctatgctccaaatacaacaccgactcaaaattccgaatcctcatagaaaaagtcaaacgagagtaccagaaaaccatgggatccatggtctgtgaggtatgccaatatgaatgtgagaccgcaaaagaacttgagtcccatcgcaaatcatgctcaatcggctcatgcccctactgcctgaacccatcggaggcaaccacaagtgccctccaggcacacttcaaagtatgcaagctcacttcacgcttccaagaaaatctgcgcaaaagcctaacagtctacgaacccatgcagggctgctaccgaacactatccctcttccgataccgctcgcgtttcttcgtaggcctcgtctggtgcgtcctcctcgtgctagagctaatagtatgggccgcatcagccgaaacccaaaatcttaacgccggctggacagacactgcgcacgggtccggcatcataccgatgaagaccgaccttgaacttgatttcagcctgccgagctctgcctcatacacttaccgacgccaattacaaaaccccgcaaacgagcaggagaaaatcccattccacctccaattatccaaacaagtcatacacgccgaaatacaacacctgggccactggatggacgcgacctttaacctcaaaacggctttccactgctacggaagctgcgaaaagtacgcatacccgtggcaaaccgccgggtgcttcatcgagaaagactacgaatacgaaacaggttggggctgtaacccgcccgactgccccggcgtagggacaggctgcaccgcctgcggagtatacctggacaaactcaaatctgtcggaaaagtattcaaaatcgtaagccttagatacacgcgcaaagtttgcatccaactcggtacagaacaaacatgcaaaacagtcgattctaatgactgccttatcaccacctcagtaaaagtatgtctcatcggcaccatttcaaagttccagccctccgataccctacttttcttaggcccgctacaacaaggagggctaatctttaaacaatggtgtaccacaacttgccaattcggggaccctggtgatatcatgtctactccaaccggaatgaaatgcccagaactaaacggatcattccgcaagaaatgcgcatttgctaccacgcccgtatgccaattcgacgggaacaccatatccggctacaaacgcatgatcgcaacaaaagactcattccagtccttcaacgtaacggaaccccacatcagcacaagtgccctcgaatggatagaccccgactctagtctcagagaccacatcaacgtcatagtctcacgagatctatcattccaggatctctcggaaacgccatgccagatagacctagctacggccagtatagacggagcatggggctctggcgttggattcaacctagtctgcaccgtatctctgacagaatgctccgcattcctgacttccatcaaagcatgcgacgctgccatgtgctatggctccaccaccgcaaacctagtccggggtcagaataccatacacatcgtcggaaaaggaggtcactccggatctaaattcatgtgttgccacgatacgaaatgctcgtccacagggctagtggcagcagcaccccacttggaccgagtcaccggctacaaccaggccgactccgacaaaatattcgacgacggcgcccccgaatgcgggatgagctgctggtttaagaagtccggcgaatggattcttggcgtcctgaacggaaactggatggtagttgcagtcttagtcgtcctcctcatactctcaatactactcttcaccctttgctgtccccgccgaccatcgtaccgaaaagagcataagccctga

SEQ ID NO: 16800 - RNA, 1519 nt, synthetic construct
  misc_feature 1..1519: note = mRNA product Design1 comprising derived and/or modified sequence from PUUV(K27)__L08804.1__N (wt)
  source 1..1519: mol_type = other RNA
gggagaaagcttaccatgagtgacttgacagacatccaagaggagataacccgccatgagcaacaacttgttgttgccagacaaaaactcaaggatgcagagagagcagtggaagtgtacccggatgacgttatcaagaacacattacaagcaagacaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttcttcgttaaagactggccagaaaaaattagggagtttatggagaaagaatgccctttcataaagccagaagttaaacctgggacaccagcacaggaggtagaatttttgaaaagaaatagagtttacttcatgacccgccaggatgttcttgacaaaaatcatgtggctgacatcgataagttgattgactatgctgcctctggtgaccctacatcgcctgatgacatcaaatctcctaatgcaccatgggtatttgcttgtgcaccagatcggtcgcccccaacatgtatttatgttgctgggatggctgaattaggtgcattcttttccatcttacaggatatgaggaacaccattatggcatctaaaactgtgggcacagcagaagagaaactgaaaaggaagtcctccttctatcaatcatatttgcgccgaacacaatcaatggggattcaacttgatcagaggataatcctactgtacatgttggaatggggaaaagaaatggtggatcatttccatcttggtgatgacatggatcctgagctaaggggccttgctcagtcactcatagaccagaaggtaaaagagatatcaaaccaagaacccttaaagatatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16801 - RNA, 3664 nt, synthetic construct
  misc_feature 1..3664: note = mRNA product Design1 comprising derived and/or modified sequence from PUUV(K27)__L08754.1__GP (wt)
  source 1..3664: mol_type = other RNA
gggagaaagcttaccatgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16802 - RNA, 3664 nt, synthetic construct
  misc_feature 1..3664: note = mRNA product Design1 comprising derived and/or modified sequence from PUUV(K27)__L08754.1__GP (wt)
  source 1..3664: mol_type = other RNA
gggagaaagcttaccatgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcatactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttacaagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16803 - RNA, 3649 nt, synthetic construct
  misc_feature 1..3649: note = mRNA product Design1 comprising derived and/or modified sequence from PUUV(K27)__L08754.1__IgE-leader_Gn-Gc (wt)
  source 1..3649: mol_type = other RNA
gggagaaagcttaccatggactggacctggatcctgttcctcgtggccgccgcgacccgcgtccacagcgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16804 - RNA, 3649 nt, synthetic construct
  misc_feature 1..3649: note = mRNA product Design1 comprising derived and/or modified sequence from PUUV(K27)__L08754.1__IgE-leader_Gn-Gc (wt)
  source 1..3649: mol_type = other RNA
gggagaaagcttaccatggactggacctggatcctgttcctcgtggccgccgcgacccgcgtccacagcgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcatactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttacaagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16805 - RNA, 1519 nt, synthetic construct
  misc_feature 1..1519: note = mRNA product Design1 comprising derived and/or modified sequence from PUUV(K27)__L08804.1__N (opt4)
  source 1..1519: mol_type = other RNA
gggagaaagcttaccatgagcgacctgaccgacatccaggaggagatcaccagacacgagcagcagctggtggtggccagacagaagctgaaggacgccgagagagccgtggaggtgtaccccgacgacgtgatcaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcaagagccccaacgccccctgggtgttcgcctgcgcccccgacagaagcccccccacctgcatctacgtggccggcatggccgagctgggcgccttcttcagcatcctgcaggacatgagaaacaccatcatggccagcaagaccgtgggcaccgccgaggagaagctgaagagaaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16806 - RNA, 3664 nt, synthetic construct
  misc_feature 1..3664: note = mRNA product Design1 comprising derived and/or modified sequence from PUUV(K27)__L08754.1__GP (opt4)
  source 1..3664: mol_type = other RNA
gggagaaagcttaccatgggcgagctgagccccgtgtgcctgtacctgctgctgcagggcctgctgctgtgcaacaccggcgccgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcagcatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccctgtgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16807 - RNA, 3649 nt, synthetic construct
  misc_feature 1..3649: note = mRNA product Design1 comprising derived and/or modified sequence from PUUV(K27)__L08754.1__IgE-leader_Gn-Gc (opt4)
  source 1..3649: mol_type = other RNA
gggagaaagcttaccatggactggacctggatcctgttcctggtggccgccgccaccagagtgcacagcgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcagcatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccctgtgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16808 - RNA, 1519 nt, synthetic construct
  misc_feature 1..1519: note = mRNA product Design1 comprising derived and/or modified sequence from PUUV(K27)__L08804.1__N (opt3)
  source 1..1519: mol_type = other RNA
gggagaaagcttaccatgagcgacctgaccgatatccaggaggaaattacaagacacgagcaacagctcgtggtcgccaggcagaaacttaaagacgctgaacgggcagttgaggtgtaccccgatgacgtaataaagaacactctgcaggcccgccaacagacggtgtccgcgttggaagataaattagctgactataagcgacgtatggccgatgcagtctctagaaagaagatggacaccaagcctacagatccaactggcatcgagccggacgatcatctgaaagagaggtcaagtctacggtacgggaatgtgctcgacgttaacgccattgatatcgaagaacccagcggacagaccgctgactggtatacaattggtgtgtacgtcatcggcttcaccatacctatcattctgaaggcactttatatgctgtccactcgcgggagacagacagtgaaagaaaataagggaaccaggatccggtttaaagacgatacgtctttcgaggacattaacggcatccgccgaccaaagcacttgtacgtatcgatgcccactgcccaatcaaccatgaaggctgaggaactcacacctggtagatttaggactatagtttgcgggctgttcccaacccagattcaggtgcggaatatcatgagccccgtcatgggagtgattggctttagtttctttgtgaaagattggcctgagaagatccgtgagttcatggagaaagaatgtccatttatcaagccggaggtcaaacccggcacccctgcccaggaggttgagttcctgaagcgcaacagagtgtattttatgacaaggcaagacgtactcgataaaaatcatgtggcggacattgataagttaatagactacgcagcctccggggatccaacgtctcccgacgatatcaagagccctaacgctccatgggtcttcgcctgcgcacccgaccggtccccgcctacttgtatttacgtggctggaatggccgaactgggtgcgtttttctcaatccttcaggacatgcgaaatacaataatggccagtaaaaccgttggcactgcagaagagaagttgaaacgcaagagctctttctatcagtcctacctgagaaggacacaatcaatggggattcagctagatcagcggatcatcctcctgtatatgcttgaatggggaaaagagatggtggaccactttcatctgggcgatgacatggatcccgagttgcgcggtctcgctcagagcctgattgaccaaaaggtcaaggaaatcagtaaccaggagccattaaaaatttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16809 - RNA, 3664 nt, synthetic construct
  misc_feature 1..3664: note = mRNA product Design1 comprising derived and/or modified sequence from PUUV(K27)__L08754.1__GP (opt3)
  source 1..3664: mol_type = other RNA
gggagaaagcttaccatgggcgagctgagccccgtgtgcctctaccttctgttgcaggggttactgctatgtaacaccggagccgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgctccattaacagagttcagaggttccggggaagcgagcaacagatcaagtttgtgtgtcagcgcgtcgacatggacatcacagtgtactgcaacggcatgaaaaaggtaattctgaccaagactttggttatcggtcagtgtatttataccttcacatctatattctcactcatccccggggtggcccacagtctggcagtcgagttatgcgtgccgggcctgcatggatgggctaccatgctactcctgcttactttgtgttttggctgggtcctgattcctacaatcacgatgatcctcctgaaaattcttatagccttcgcttacctgtgcagcaagtataataccgattccaaatttcgaatcttgattgaaaaggtgaaaagagagtaccaaaagactatggggtctatggtttgcgaagtgtgtcagtacgagtgcgaaacagccaaggagctcgagtcgcacaggaaaagctgttccatcggatcatgcccctattgtctgaacccaagtgaagcaaccacatctgccttacaggctcatttcaaggtatgcaaactgactagccggtttcaggagaatctacgtaagtccctcaccgtctacgaacctatgcaaggttgttatcgcacgctgtcacttttcagatacaggagccggtttttcgtgggcttggtttggtgcgtgctgctcgtcctggagttaattgtgtgggcggcatctgccgagacccagaacctgaatgctgggtggacagacactgcccacggatccggcatcatacccatgaaaaccgatcttgaattggactttagtctcccaagctctgcatcctatacataccgacgccagctgcagaaccccgccaatgagcaagaaaagatccctttccacctacagctgtcaaagcaggtaattcatgctgagatccaacacctcggtcattggatggatgccacttttaacctgaaaaccgcattccactgttatgggagttgcgaaaagtacgcgtacccatggcagacggctggctgttttattgagaaagactatgagtacgaaacaggatggggctgcaatccgcccgattgccctggggtgggaaccggttgtactgcctgcggcgtttatcttgacaagttgaaaagcgtcgggaaggtgttcaagatcgtgtcgctgagatacacaaggaaagtctgtatacagttaggaaccgagcagacttgcaagaccgttgattccaacgactgtctcattacaacgtctgtgaaagtgtgcctgatcggcaccattagcaagttccaaccatcagatactcttctgtttttgggtcccctccagcaagggggcctgatcttcaaacagtggtgtacaaccacatgccagtttggagaccctggcgacataatgagtactccaaccgggatgaagtgtcccgaactaaatggatccttccggaaaaagtgcgcatttgccacgacaccggtatgtcagttcgatggcaacaccatctctggttataagcgcatgattgctactaaagacagctttcagtccttcaatgtcaccgagcctcatatctcaacaagcgccctggaatggattgatccagacagttctctcagagatcacatcaacgtgatagtttccagggacctgagctttcaggatctttcggagactccctgccaaattgacttggcaaccgcttcaatcgatggggcctggggatctggcgtgggtttcaatctggtctgcacagtgagtttaacggagtgttccgcgtttctcaccagcatcaaggcctgcgacgctgcaatgtgttacggctctactacagccaacctggttcgtgggcagaacaccattcacatcgtgggaaaaggcgggcatagcggatccaagttcatgtgctgtcacgatactaaatgctcaagtacaggccttgtagctgccgcacctcatctggaccgggtcaccggttataatcaggcggatagcgacaagatttttgacgatggggcccccgaatgtggaatgtcttgctggttcaagaaatccggcgagtggatactaggtgtgctcaacggcaattggatggtggtcgctgttctggtggtattgctgatcttatcaattctcctgttcacgctttgttgcccacgaagacctagttacaggaaggaacacaaaccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16810 - RNA, 3649 nt, synthetic construct
  misc_feature 1..3649: note = mRNA product Design1 comprising derived and/or modified sequence from PUUV(K27)__L08754.1__IgE-leader_Gn-Gc (opt3)
  source 1..3649: mol_type = other RNA
gggagaaagcttaccatggactggacctggatcctgttcctcgtggccgctgcaacaagagtccacagcgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgctccattaacagagttcagaggttccggggaagcgagcaacagatcaagtttgtgtgtcagcgcgtcgacatggacatcacagtgtactgcaacggcatgaaaaaggtaattctgaccaagactttggttatcggtcagtgtatttataccttcacatctatattctcactcatccccggggtggcccacagtctggcagtcgagttatgcgtgccgggcctgcatggatgggctaccatgctactcctgcttactttgtgttttggctgggtcctgattcctacaatcacgatgatcctcctgaaaattcttatagccttcgcttacctgtgcagcaagtataataccgattccaaatttcgaatcttgattgaaaaggtgaaaagagagtaccaaaagactatggggtctatggtttgcgaagtgtgtcagtacgagtgcgaaacagccaaggagctcgagtcgcacaggaaaagctgttccatcggatcatgcccctattgtctgaacccaagtgaagcaaccacatctgccttacaggctcatttcaaggtatgcaaactgactagccggtttcaggagaatctacgtaagtccctcaccgtctacgaacctatgcaaggttgttatcgcacgctgtcacttttcagatacaggagccggtttttcgtgggcttggtttggtgcgtgctgctcgtcctggagttaattgtgtgggcggcatctgccgagacccagaacctgaatgctgggtggacagacactgcccacggatccggcatcatacccatgaaaaccgatcttgaattggactttagtctcccaagctctgcatcctatacataccgacgccagctgcagaaccccgccaatgagcaagaaaagatccctttccacctacagctgtcaaagcaggtaattcatgctgagatccaacacctcggtcattggatggatgccacttttaacctgaaaaccgcattccactgttatgggagttgcgaaaagtacgcgtacccatggcagacggctggctgttttattgagaaagactatgagtacgaaacaggatggggctgcaatccgcccgattgccctggggtgggaaccggttgtactgcctgcggcgtttatcttgacaagttgaaaagcgtcgggaaggtgttcaagatcgtgtcgctgagatacacaaggaaagtctgtatacagttaggaaccgagcagacttgcaagaccgttgattccaacgactgtctcattacaacgtctgtgaaagtgtgcctgatcggcaccattagcaagttccaaccatcagatactcttctgtttttgggtcccctccagcaagggggcctgatcttcaaacagtggtgtacaaccacatgccagtttggagaccctggcgacataatgagtactccaaccgggatgaagtgtcccgaactaaatggatccttccggaaaaagtgcgcatttgccacgacaccggtatgtcagttcgatggcaacaccatctctggttataagcgcatgattgctactaaagacagctttcagtccttcaatgtcaccgagcctcatatctcaacaagcgccctggaatggattgatccagacagttctctcagagatcacatcaacgtgatagtttccagggacctgagctttcaggatctttcggagactccctgccaaattgacttggcaaccgcttcaatcgatggggcctggggatctggcgtgggtttcaatctggtctgcacagtgagtttaacggagtgttccgcgtttctcaccagcatcaaggcctgcgacgctgcaatgtgttacggctctactacagccaacctggttcgtgggcagaacaccattcacatcgtgggaaaaggcgggcatagcggatccaagttcatgtgctgtcacgatactaaatgctcaagtacaggccttgtagctgccgcacctcatctggaccgggtcaccggttataatcaggcggatagcgacaagatttttgacgatggggcccccgaatgtggaatgtcttgctggttcaagaaatccggcgagtggatactaggtgtgctcaacggcaattggatggtggtcgctgttctggtggtattgctgatcttatcaattctcctgttcacgctttgttgcccacgaagacctagttacaggaaggaacacaaaccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16811 - RNA, 1519 nt, synthetic construct
  misc_feature 1..1519: note = mRNA product Design1 comprising derived and/or modified sequence from PUUV(K27)__L08804.1__N (opt1)
  source 1..1519: mol_type = other RNA
gggagaaagcttaccatgagcgacctgaccgacatccaggaggagatcacccgccacgagcagcagctcgtggtcgcccggcagaagctgaaggacgccgagcgcgcggtggaggtgtaccccgacgacgtcatcaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagaagatccgcgagttcatggagaaggagtgccccttcatcaagccggaggtgaagcccgggacccccgcccaggaggtcgagttcctgaagcggaaccgcgtgtacttcatgacccggcaggacgtgctcgacaagaaccacgtcgccgacatcgacaagctgatcgactacgccgcgagcggcgaccccacctccccggacgacatcaagagccccaacgccccctgggtgttcgcctgcgcccccgaccgctccccgcccacgtgcatctacgtggccggcatggcggagctgggggccttcttcagcatcctccaggacatgcgcaacaccatcatggcctccaagaccgtcggcaccgccgaggagaagctgaagcgcaagagctccttctaccagagctacctgcggcggacgcagagcatggggatccagctcgaccagcgcatcatcctgctgtacatgctcgagtggggcaaggagatggtggaccacttccacctgggcgacgacatggaccccgagctgcgggggctcgcccagtccctgatcgaccagaaggtcaaggagatcagcaaccaggagcccctgaagatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16812 - RNA, 3664 nt, synthetic construct
  misc_feature 1..3664: note = mRNA product Design1 comprising derived and/or modified sequence from PUUV(K27)__L08754.1__GP (opt1)
  source 1..3664: mol_type = other RNA
gggagaaagcttaccatgggcgagctgagccccgtgtgcctctacctgctgctccaggggctgctgctctgcaacaccggcgccgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgctccatcaaccgcgtccagcggttccgcggcagcgagcagcagatcaagttcgtgtgccagcgggtcgacatggacatcaccgtgtactgcaacgggatgaagaaggtgatcctgaccaagaccctggtcatcggccagtgcatctacacgttcacctccatcttcagcctcatccccggcgtggcccacagcctggccgtggagctgtgcgtccccgggctccacggctgggccaccatgctgctgctcctgaccctgtgcttcgggtgggtgctgatccccacgatcaccatgatcctcctgaagatcctgatcgcgttcgcctacctctgctccaagtacaacaccgacagcaagttccgcatcctgatcgagaaggtgaagcgggagtaccagaagaccatgggctccatggtctgcgaggtgtgccagtacgagtgcgagacggccaaggagctggagagccaccgcaagtcctgcagcatcgggtcctgcccctactgcctcaaccccagcgaggccaccacctccgccctgcaggcgcacttcaaggtgtgcaagctgaccagccggttccaggagaacctccgcaagtccctgacggtctacgagccgatgcagggctgctaccggaccctgagcctcttccgctaccggtcccgcttcttcgtgggcctggtgtggtgcgtcctgctcgtgctggagctgatcgtgtgggccgccagcgccgagacccagaacctcaacgcggggtggaccgacacggcccacggctccgggatcatccccatgaagaccgacctggagctggacttcagcctcccctccagcgccagctacacctaccgccggcagctgcagaaccccgccaacgagcaggagaagatcccgttccacctccagctctccaagcaggtcatccacgccgagatccagcacctgggccactggatggacgcgaccttcaacctgaagacggccttccactgctacggcagctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctgaagtccgtcgggaaggtgttcaagatcgtgagcctgcgctacacccggaaggtctgcatccagctcggcaccgagcagacctgcaagacggtggactccaacgactgcctgatcaccaccagcgtgaaggtctgcctgatcgggaccatctccaagttccagcccagcgacacgctcctgttcctgggccccctccagcagggcgggctgatcttcaagcagtggtgcaccacgacctgccagttcggcgacccgggggacatcatgtccacccccaccggcatgaagtgccccgagctgaacgggagcttccgcaagaagtgcgcgttcgccaccacccccgtgtgccagttcgacggcaacaccatctccgggtacaagcggatgatcgccacgaaggacagcttccagtccttcaacgtgaccgagccgcacatcagcacctccgccctcgagtggatcgaccccgacagctccctgcgcgaccacatcaacgtcatcgtgagccgggacctgtccttccaggacctcagcgagaccccctgccagatcgacctggccacggcgagcatcgacggcgcctggggctccggggtgggcttcaacctggtctgcaccgtgagcctcaccgagtgctccgccttcctgaccagcatcaaggcctgcgacgcggccatgtgctacgggtccacgaccgccaacctggtgcgcggccagaacaccatccacatcgtcgggaagggcggccacagcgggtccaagttcatgtgctgccacgacaccaagtgcagctccacgggcctcgtggccgccgcgccccacctggaccgggtgaccgggtacaaccaggccgacagcgacaagatcttcgacgacggcgccccggagtgcggcatgtcctgctggttcaagaagtccggggagtggatcctgggcgtcctcaacgggaactggatggtggtggccgtcctggtggtgctgctcatcctgagcatcctgctgttcaccctgtgctgcccccgccggcccagctaccgcaaggagcacaagccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16813 - RNA, 3649 nt, synthetic construct
  misc_feature 1..3649: note = mRNA product Design1 comprising derived and/or modified sequence from PUUV(K27)__L08754.1__IgE-leader_Gn-Gc (opt1)
  source 1..3649: mol_type = other RNA
gggagaaagcttaccatggactggacctggatcctgttcctcgtggccgccgcgacccgcgtccacagcgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgctccatcaaccgcgtccagcggttccgcggcagcgagcagcagatcaagttcgtgtgccagcgggtcgacatggacatcaccgtgtactgcaacgggatgaagaaggtgatcctgaccaagaccctggtcatcggccagtgcatctacacgttcacctccatcttcagcctcatccccggcgtggcccacagcctggccgtggagctgtgcgtccccgggctccacggctgggccaccatgctgctgctcctgaccctgtgcttcgggtgggtgctgatccccacgatcaccatgatcctcctgaagatcctgatcgcgttcgcctacctctgctccaagtacaacaccgacagcaagttccgcatcctgatcgagaaggtgaagcgggagtaccagaagaccatgggctccatggtctgcgaggtgtgccagtacgagtgcgagacggccaaggagctggagagccaccgcaagtcctgcagcatcgggtcctgcccctactgcctcaaccccagcgaggccaccacctccgccctgcaggcgcacttcaaggtgtgcaagctgaccagccggttccaggagaacctccgcaagtccctgacggtctacgagccgatgcagggctgctaccggaccctgagcctcttccgctaccggtcccgcttcttcgtgggcctggtgtggtgcgtcctgctcgtgctggagctgatcgtgtgggccgccagcgccgagacccagaacctcaacgcggggtggaccgacacggcccacggctccgggatcatccccatgaagaccgacctggagctggacttcagcctcccctccagcgccagctacacctaccgccggcagctgcagaaccccgccaacgagcaggagaagatcccgttccacctccagctctccaagcaggtcatccacgccgagatccagcacctgggccactggatggacgcgaccttcaacctgaagacggccttccactgctacggcagctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctgaagtccgtcgggaaggtgttcaagatcgtgagcctgcgctacacccggaaggtctgcatccagctcggcaccgagcagacctgcaagacggtggactccaacgactgcctgatcaccaccagcgtgaaggtctgcctgatcgggaccatctccaagttccagcccagcgacacgctcctgttcctgggccccctccagcagggcgggctgatcttcaagcagtggtgcaccacgacctgccagttcggcgacccgggggacatcatgtccacccccaccggcatgaagtgccccgagctgaacgggagcttccgcaagaagtgcgcgttcgccaccacccccgtgtgccagttcgacggcaacaccatctccgggtacaagcggatgatcgccacgaaggacagcttccagtccttcaacgtgaccgagccgcacatcagcacctccgccctcgagtggatcgaccccgacagctccctgcgcgaccacatcaacgtcatcgtgagccgggacctgtccttccaggacctcagcgagaccccctgccagatcgacctggccacggcgagcatcgacggcgcctggggctccggggtgggcttcaacctggtctgcaccgtgagcctcaccgagtgctccgccttcctgaccagcatcaaggcctgcgacgcggccatgtgctacgggtccacgaccgccaacctggtgcgcggccagaacaccatccacatcgtcgggaagggcggccacagcgggtccaagttcatgtgctgccacgacaccaagtgcagctccacgggcctcgtggccgccgcgccccacctggaccgggtgaccgggtacaaccaggccgacagcgacaagatcttcgacgacggcgccccggagtgcggcatgtcctgctggttcaagaagtccggggagtggatcctgggcgtcctcaacgggaactggatggtggtggccgtcctggtggtgctgctcatcctgagcatcctgctgttcaccctgtgctgcccccgccggcccagctaccgcaaggagcacaagccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16814 - RNA, 1519 nt, synthetic construct
  misc_feature 1..1519: note = mRNA product Design1 comprising derived and/or modified sequence from PUUV(K27)__L08804.1__N (opt5)
  source 1..1519: mol_type = other RNA
gggagaaagcttaccatgagcgacctgaccgatatccaggaggaaattacaagacacgagcaacagctcgtggtcgcccggcagaagctgaaagacgctgaacgcgccgttgaggtgtaccccgatgacgtgatcaagaacacgcttcaggcgagacaacagaccgtctccgctctggaagataaactcgccgactataagcggcgcatggccgatgctgtgtctcggaaaaagatggacacaaagcctaccgatccgacaggcattgagcccgacgatcatctgaaagagagaagctcccttcgctacgggaatgttctggacgtgaacgccatcgatattgaagaaccttctggacagaccgctgactggtatacaatcggcgtctacgtgatcgggttcaccattcccatcattctcaaggccctgtatatgctgagcacgagaggacggcagaccgttaaagaaaataagggcacacgcatcagatttaaagacgatacctccttcgaggacattaacgggatccggcgccctaagcacctctacgtgtctatgcccacagcgcaaagcaccatgaaggccgaggaactgacgcctggaagatttcggacaattgtctgcggccttttcccgacccagatccaggtgcgcaatatcatgtcccccgtgatgggcgtcattgggtttagcttctttgttaaagattggcctgagaagatcagagagttcatggagaaagaatgtccctttattaagcctgaggtgaaacccggaacaccggctcaggaggtggagttcctgaagcggaacagagtctattttatgacccgccaagacgtgctcgataaaaatcatgttgccgacatcgataagctgattgactacgctgcctctggcgatcctacctcccccgacgatatcaagagccctaacgcgccctgggtgttcgcctgcgctcccgaccggtctcctccgacatgtatctacgtcgccgggatggctgaacttggagcctttttctccattctgcaggacatgagaaatacgatcatggccagcaaaaccgtgggcacagctgaagagaagctcaaacgcaagtcttccttctatcagagctacctgcggagaacccaatccatggggattcagctggatcagcgcatcattctcctgtatatgcttgaatggggaaaagagatggttgaccactttcatctgggcgatgacatggatcccgagctccggggcctggcgcagtctcttatcgaccaaaaggtgaaggaaatcagcaaccaggagcctctgaaaatttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16815 - RNA, 3664 nt, synthetic construct
  misc_feature 1..3664: note = mRNA product Design1 comprising derived and/or modified sequence from PUUV(K27)__L08754.1__GP (opt5)
  source 1..3664: mol_type = other RNA
gggagaaagcttaccatgggcgagctgagccccgtgtgcctctacctgcttctgcaggggctcctgctttgtaacaccggagccgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccctacctgcagcattaaccgggtgcagcgcttcagaggctctgagcaacagatcaagtttgtttgtcagcgggtggacatggacattacagtctactgcaacgggatgaaaaaggtgatcctgaccaagacgctcgtcatcggacagtgtatttataccttcacatccatcttcagcctgattcccggcgtggcccactccctggctgttgagctctgcgtgcccgggctgcatggatgggcgaccatgcttctgctcctgacactgtgttttggctgggtccttatcccgaccattacgatgatcctcctgaaaattctgatcgccttcgcttacctctgctctaagtataatacagatagcaaatttcgcatcctgattgaaaaggtgaaaagagagtaccaaaagaccatggggtccatggtttgcgaagtgtgtcagtacgagtgcgaaacagccaaggagcttgagtctcaccggaaaagctgttccatcggcagctgcccctattgtctgaacccttctgaagccaccacctccgctctccaggcccatttcaaggtctgcaaactgacaagccgctttcaggagaatctgagaaagtctcttacggtgtacgaacccatgcaaggatgttatcggaccctctccctgttcagataccgcagccggtttttcgtgggcctggtttggtgcgtcctcctggtgcttgagctgattgtgtgggcggcttctgccgagacacagaacctcaatgccgggtggaccgacacagctcacggaagcggcatcattcctatgaaaaccgatctggaactggacttttcccttcccagctctgcctcctatacgtacagacgccagctccagaacccggctaatgagcaagaaaagatccctttccatctgcagctgagcaagcaggtcatccacgccgagattcaacacctcgggcattggatggatgcgacatttaacctgaaaaccgccttccactgttatggatcctgcgaaaagtacgcttacccctggcagaccgccggctgttttatcgagaaagactatgagtacgaaacagggtggggctgcaatcctcccgattgccctggagtgggcaccgggtgtacagcttgcggagtttatcttgacaagctgaaatctgtgggcaaggtcttcaagattgtgagcctccggtacacgagaaaagtttgtatccagctggggaccgagcagacatgcaagaccgtggattccaacgactgtctgattacaacctctgtcaaagtgtgccttatcggaacgatcagcaagttccaaccctccgataccctcctgtttctgggcccgctccagcagggaggcctgattttcaaacagtggtgtacaaccacatgccaatttggagaccctggcgacatcatgtctacccccacagggatgaagtgtcccgaacttaatgggagcttccgcaaaaagtgcgcctttgcgaccacgcctgtttgtcagttcgatggcaacacaatttccgggtataagcggatgatcgccaccaaagacagctttcagtctttcaatgtgaccgagccgcatatttccacaagcgctctggaatggatcgatcccgactcttccctcagagatcacatcaacgtcattgtgagccgcgacctgtcttttcaggatctgtccgagaccccttgccaaatcgaccttgccacggctagcattgatggagcctggggctccggggtgggcttcaatctggtctgcacagttagcctcaccgagtgttctgcctttctgacaagcatcaaggcttgcgacgcggccatgtgttacggatccaccacagctaacctcgtgcggggccagaacaccattcacatcgtggggaaaggaggccattctgggagcaagttcatgtgctgtcacgatacgaaatgctcctctaccggactggtcgccgccgctccccatcttgacagagtgacaggctataatcaggccgatagcgacaagatttttgacgatggcgcgcctgaatgtgggatgtcctgctggttcaagaaatctggagagtggatcctgggcgttctcaacgggaattggatggtggtcgctgtgctggttgtgctgcttatcctgagcattctcctgttcaccctctgttgcccccgccggccttcctacagaaaggaacacaaaccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16816 - RNA, 3649 nt, synthetic construct
  misc_feature 1..3649: note = mRNA product Design1 comprising derived and/or modified sequence from PUUV(K27)__L08754.1__IgE-leader_Gn-Gc (opt5)
  source 1..3649: mol_type = other RNA
gggagaaagcttaccatggactggacctggatcctgttcctcgtggccgctgccacaagagtccacagcgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccctacctgcagcattaaccgggtgcagcgcttcagaggctctgagcaacagatcaagtttgtttgtcagcgggtggacatggacattacagtctactgcaacgggatgaaaaaggtgatcctgaccaagacgctcgtcatcggacagtgtatttataccttcacatccatcttcagcctgattcccggcgtggcccactccctggctgttgagctctgcgtgcccgggctgcatggatgggcgaccatgcttctgctcctgacactgtgttttggctgggtccttatcccgaccattacgatgatcctcctgaaaattctgatcgccttcgcttacctctgctctaagtataatacagatagcaaatttcgcatcctgattgaaaaggtgaaaagagagtaccaaaagaccatggggtccatggtttgcgaagtgtgtcagtacgagtgcgaaacagccaaggagcttgagtctcaccggaaaagctgttccatcggcagctgcccctattgtctgaacccttctgaagccaccacctccgctctccaggcccatttcaaggtctgcaaactgacaagccgctttcaggagaatctgagaaagtctcttacggtgtacgaacccatgcaaggatgttatcggaccctctccctgttcagataccgcagccggtttttcgtgggcctggtttggtgcgtcctcctggtgcttgagctgattgtgtgggcggcttctgccgagacacagaacctcaatgccgggtggaccgacacagctcacggaagcggcatcattcctatgaaaaccgatctggaactggacttttcccttcccagctctgcctcctatacgtacagacgccagctccagaacccggctaatgagcaagaaaagatccctttccatctgcagctgagcaagcaggtcatccacgccgagattcaacacctcgggcattggatggatgcgacatttaacctgaaaaccgccttccactgttatggatcctgcgaaaagtacgcttacccctggcagaccgccggctgttttatcgagaaagactatgagtacgaaacagggtggggctgcaatcctcccgattgccctggagtgggcaccgggtgtacagcttgcggagtttatcttgacaagctgaaatctgtgggcaaggtcttcaagattgtgagcctccggtacacgagaaaagtttgtatccagctggggaccgagcagacatgcaagaccgtggattccaacgactgtctgattacaacctctgtcaaagtgtgccttatcggaacgatcagcaagttccaaccctccgataccctcctgtttctgggcccgctccagcagggaggcctgattttcaaacagtggtgtacaaccacatgccaatttggagaccctggcgacatcatgtctacccccacagggatgaagtgtcccgaacttaatgggagcttccgcaaaaagtgcgcctttgcgaccacgcctgtttgtcagttcgatggcaacacaatttccgggtataagcggatgatcgccaccaaagacagctttcagtctttcaatgtgaccgagccgcatatttccacaagcgctctggaatggatcgatcccgactcttccctcagagatcacatcaacgtcattgtgagccgcgacctgtcttttcaggatctgtccgagaccccttgccaaatcgaccttgccacggctagcattgatggagcctggggctccggggtgggcttcaatctggtctgcacagttagcctcaccgagtgttctgcctttctgacaagcatcaaggcttgcgacgcggccatgtgttacggatccaccacagctaacctcgtgcggggccagaacaccattcacatcgtggggaaaggaggccattctgggagcaagttcatgtgctgtcacgatacgaaatgctcctctaccggactggtcgccgccgctccccatcttgacagagtgacaggctataatcaggccgatagcgacaagatttttgacgatggcgcgcctgaatgtgggatgtcctgctggttcaagaaatctggagagtggatcctgggcgttctcaacgggaattggatggtggtcgctgtgctggttgtgctgcttatcctgagcattctcctgttcaccctctgttgcccccgccggccttcctacagaaaggaacacaaaccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16817 - RNA, 1519 nt, synthetic construct
  misc_feature 1..1519: note = mRNA product Design1 comprising derived and/or modified sequence from PUUV(K27)__L08804.1__N (opt11)
  source 1..1519: mol_type = other RNA
gggagaaagcttaccatgtccgacctcaccgacatccaagaagaaatcacccgccacgaacagcaactggtagtcgcccgacaaaagctcaaagacgccgaacgcgccgtcgaagtataccccgacgacgtcatcaaaaatacactacaagccagacagcaaacagtcagcgccctcgaagacaaactagccgactacaaaagacgcatggccgacgcagtctcacgcaagaaaatggacaccaaacccacagacccaaccggaatagaacccgacgaccacctaaaagaacgatcctccctccgctacggtaacgtactcgacgtcaacgccatcgacatcgaagaaccatccggccaaactgccgactggtacacaatcggcgtctacgtcataggcttcaccatccccatcatcctaaaagccctatacatgctctcaacccggggccggcaaacagtcaaagaaaacaaaggcacccggatccgcttcaaagacgacacctccttcgaagacattaatggcatccgccgcccaaaacacttatacgtatccatgccaaccgcacaatcaacaatgaaagcagaagaactcaccccaggacgcttccgcaccatcgtctgcggcctcttccccacacaaatccaagtccgcaacatcatgtcccccgtcatgggagtcatcggattctccttcttcgtcaaagactggcccgaaaagatacgcgagttcatggaaaaagaatgccccttcatcaaacccgaagtcaaacccggcacccccgcccaagaagtcgagttcctcaaacgcaaccgcgtctacttcatgacccgacaagacgtcctcgacaaaaaccacgtagccgacatcgacaaactgatcgactacgctgcctctggcgaccccacctcacccgacgacataaaaagccccaacgcaccatgggtcttcgcatgcgccccagaccgatccccacccacttgcatatacgtagccggcatggccgaactcggcgccttcttcagcatcctccaagacatgcgtaacacaataatggcctccaagaccgtcggcaccgccgaagaaaagctaaaacgtaaatcatcgttctaccaatcctacctaagacgcacacaatccatgggcatacaactagaccaacgcatcatcctcctatacatgctcgaatggggaaaagaaatggtcgaccatttccacctaggcgacgacatggatcccgaactgcgcggactcgcccaaagcctcatcgaccagaaagtcaaagaaatctccaaccaagaacccctaaaaatctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16818 - RNA, 3664 nt, synthetic construct
  misc_feature 1..3664: note = mRNA product Design1 comprising derived and/or modified sequence from PUUV(K27)__L08754.1__GP (opt11)
  source 1..3664: mol_type = other RNA
gggagaaagcttaccatgggtgagctctcaccggtctgcctatatctcctcctccagggcctgctgctttgcaacaccggagccgcccgcaatctaaacgaactcaaaatggaatgcccccacacaatccgactcggacaaggcctagtcgtcggatccgtagaactacccagcctccccatccaacaagtcgagacactcaaactcgaatccagttgcaatttcgacctccataccagcaccgccggccagcaatccttcacaaaatggacctgggaaataaaaggcgacctcgcggagaacacacaagcctctagcacatctttccaaaccaaaagcagcgaagttaacctccgaggcctgtgccttatccccaccctcgttgtcgaaaccgcagcacgcatgcgcaaaaccatagcatgctacgacctcagctgcaaccaaacagtctgccaaccaacagtctacctaatgggccctattcaaacatgcatcacaaccaaaagctgcctcctcagcctcggcgaccaaagaatacaagtaaactacgagaaaacgtactgcgtatctggtcagctcgtcgaaggcatctgcttcaaccccatacacacaatggcactttcacaaccctcacacacttacgacatcatgaccatgatggtccgatgcttcctggtgatcaagaaagttacctcaggtgacagcatgaaaatagagaaaaacttcgaaacactcgtccagaaaaacggctgcaccgccaacaacttccaaggatactatatctgcctgataggatcatcatcagaaccgctgtacgtcccggccctagacgactaccgatctgccgaagttctttctcgcatggccttcgcaccacacggcgaagatcacgacatagagaaaaacgcagtcagcgcaatgaggatcgcaggcaaagtaacgggcaaagctcccagcacagaaagctctgataccgtacaggggatcgcattcagcggcagcccactttacacctccactggcgtattaacaagcaaggacgaccccgtgtacatctgggccccaggcattatcatggaaggtaaccactccatatgtgaaaagaaaaccttgccgctcacttggaccggatttatctctctccccggcgaaatcgagaaaacgacccaatgcacagtcttttgtaccctagcaggaccaggcgccgactgcgaagcatacagcgaaaccggcatcttcaacattagcagccctacttgctccatcaaccgcgttcaacggttccgaggctcggaacagcaaataaaattcgtctgccaacgcgtagacatggacataaccgtctactgcaacgggatgaagaaagtcattcttaccaaaaccctagtgatagggcaatgtatatataccttcacatctatcttctcactcatcccaggagttgcacattccctcgccgtcgaactctgtgtacccggcctacatggctgggccaccatgctcctactactcaccctatgcttcggctgggtcctaatacccaccataaccatgatccttctaaaaatactcatagctttcgcctacctatgctccaaatacaacaccgactcaaaattccgaatcctcatagaaaaagtcaaacgagagtaccagaaaaccatgggatccatggtctgtgaggtatgccaatatgaatgtgagaccgcaaaagaacttgagtcccatcgcaaatcatgctcaatcggctcatgcccctactgcctgaacccatcggaggcaaccacaagtgccctccaggcacacttcaaagtatgcaagctcacttcacgcttccaagaaaatctgcgcaaaagcctaacagtctacgaacccatgcagggctgctaccgaacactatccctcttccgataccgctcgcgtttcttcgtaggcctcgtctggtgcgtcctcctcgtgctagagctaatagtatgggccgcatcagccgaaacccaaaatcttaacgccggctggacagacactgcgcacgggtccggcatcataccgatgaagaccgaccttgaacttgatttcagcctgccgagctctgcctcatacacttaccgacgccaattacaaaaccccgcaaacgagcaggagaaaatcccattccacctccaattatccaaacaagtcatacacgccgaaatacaacacctgggccactggatggacgcgacctttaacctcaaaacggctttccactgctacggaagctgcgaaaagtacgcatacccgtggcaaaccgccgggtgcttcatcgagaaagactacgaatacgaaacaggttggggctgtaacccgcccgactgccccggcgtagggacaggctgcaccgcctgcggagtatacctggacaaactcaaatctgtcggaaaagtattcaaaatcgtaagccttagatacacgcgcaaagtttgcatccaactcggtacagaacaaacatgcaaaacagtcgattctaatgactgccttatcaccacctcagtaaaagtatgtctcatcggcaccatttcaaagttccagccctccgataccctacttttcttaggcccgctacaacaaggagggctaatctttaaacaatggtgtaccacaacttgccaattcggggaccctggtgatatcatgtctactccaaccggaatgaaatgcccagaactaaacggatcattccgcaagaaatgcgcatttgctaccacgcccgtatgccaattcgacgggaacaccatatccggctacaaacgcatgatcgcaacaaaagactcattccagtccttcaacgtaacggaaccccacatcagcacaagtgccctcgaatggatagaccccgactctagtctcagagaccacatcaacgtcatagtctcacgagatctatcattccaggatctctcggaaacgccatgccagatagacctagctacggccagtatagacggagcatggggctctggcgttggattcaacctagtctgcaccgtatctctgacagaatgctccgcattcctgacttccatcaaagcatgcgacgctgccatgtgctatggctccaccaccgcaaacctagtccggggtcagaataccatacacatcgtcggaaaaggaggtcactccggatctaaattcatgtgttgccacgatacgaaatgctcgtccacagggctagtggcagcagcaccccacttggaccgagtcaccggctacaaccaggccgactccgacaaaatattcgacgacggcgcccccgaatgcgggatgagctgctggtttaagaagtccggcgaatggattcttggcgtcctgaacggaaactggatggtagttgcagtcttagtcgtcctcctcatactctcaatactactcttcaccctttgctgtccccgccgaccatcgtaccgaaaagagcataagccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16819 - RNA, 3649 nt, synthetic construct
  misc_feature 1..3649: note = mRNA product Design1 comprising derived and/or modified sequence from PUUV(K27)__L08754.1__IgE-leader_Gn-Gc (opt11)
  source 1..3649: mol_type = other RNA
gggagaaagcttaccatggattggacgtggatactctttctcgtggccgcggccacgcgcgtgcactcggcccgcaatctaaacgaactcaaaatggaatgcccccacacaatccgactcggacaaggcctagtcgtcggatccgtagaactacccagcctccccatccaacaagtcgagacactcaaactcgaatccagttgcaatttcgacctccataccagcaccgccggccagcaatccttcacaaaatggacctgggaaataaaaggcgacctcgcggagaacacacaagcctctagcacatctttccaaaccaaaagcagcgaagttaacctccgaggcctgtgccttatccccaccctcgttgtcgaaaccgcagcacgcatgcgcaaaaccatagcatgctacgacctcagctgcaaccaaacagtctgccaaccaacagtctacctaatgggccctattcaaacatgcatcacaaccaaaagctgcctcctcagcctcggcgaccaaagaatacaagtaaactacgagaaaacgtactgcgtatctggtcagctcgtcgaaggcatctgcttcaaccccatacacacaatggcactttcacaaccctcacacacttacgacatcatgaccatgatggtccgatgcttcctggtgatcaagaaagttacctcaggtgacagcatgaaaatagagaaaaacttcgaaacactcgtccagaaaaacggctgcaccgccaacaacttccaaggatactatatctgcctgataggatcatcatcagaaccgctgtacgtcccggccctagacgactaccgatctgccgaagttctttctcgcatggccttcgcaccacacggcgaagatcacgacatagagaaaaacgcagtcagcgcaatgaggatcgcaggcaaagtaacgggcaaagctcccagcacagaaagctctgataccgtacaggggatcgcattcagcggcagcccactttacacctccactggcgtattaacaagcaaggacgaccccgtgtacatctgggccccaggcattatcatggaaggtaaccactccatatgtgaaaagaaaaccttgccgctcacttggaccggatttatctctctccccggcgaaatcgagaaaacgacccaatgcacagtcttttgtaccctagcaggaccaggcgccgactgcgaagcatacagcgaaaccggcatcttcaacattagcagccctacttgctccatcaaccgcgttcaacggttccgaggctcggaacagcaaataaaattcgtctgccaacgcgtagacatggacataaccgtctactgcaacgggatgaagaaagtcattcttaccaaaaccctagtgatagggcaatgtatatataccttcacatctatcttctcactcatcccaggagttgcacattccctcgccgtcgaactctgtgtacccggcctacatggctgggccaccatgctcctactactcaccctatgcttcggctgggtcctaatacccaccataaccatgatccttctaaaaatactcatagctttcgcctacctatgctccaaatacaacaccgactcaaaattccgaatcctcatagaaaaagtcaaacgagagtaccagaaaaccatgggatccatggtctgtgaggtatgccaatatgaatgtgagaccgcaaaagaacttgagtcccatcgcaaatcatgctcaatcggctcatgcccctactgcctgaacccatcggaggcaaccacaagtgccctccaggcacacttcaaagtatgcaagctcacttcacgcttccaagaaaatctgcgcaaaagcctaacagtctacgaacccatgcagggctgctaccgaacactatccctcttccgataccgctcgcgtttcttcgtaggcctcgtctggtgcgtcctcctcgtgctagagctaatagtatgggccgcatcagccgaaacccaaaatcttaacgccggctggacagacactgcgcacgggtccggcatcataccgatgaagaccgaccttgaacttgatttcagcctgccgagctctgcctcatacacttaccgacgccaattacaaaaccccgcaaacgagcaggagaaaatcccattccacctccaattatccaaacaagtcatacacgccgaaatacaacacctgggccactggatggacgcgacctttaacctcaaaacggctttccactgctacggaagctgcgaaaagtacgcatacccgtggcaaaccgccgggtgcttcatcgagaaagactacgaatacgaaacaggttggggctgtaacccgcccgactgccccggcgtagggacaggctgcaccgcctgcggagtatacctggacaaactcaaatctgtcggaaaagtattcaaaatcgtaagccttagatacacgcgcaaagtttgcatccaactcggtacagaacaaacatgcaaaacagtcgattctaatgactgccttatcaccacctcagtaaaagtatgtctcatcggcaccatttcaaagttccagccctccgataccctacttttcttaggcccgctacaacaaggagggctaatctttaaacaatggtgtaccacaacttgccaattcggggaccctggtgatatcatgtctactccaaccggaatgaaatgcccagaactaaacggatcattccgcaagaaatgcgcatttgctaccacgcccgtatgccaattcgacgggaacaccatatccggctacaaacgcatgatcgcaacaaaagactcattccagtccttcaacgtaacggaaccccacatcagcacaagtgccctcgaatggatagaccccgactctagtctcagagaccacatcaacgtcatagtctcacgagatctatcattccaggatctctcggaaacgccatgccagatagacctagctacggccagtatagacggagcatggggctctggcgttggattcaacctagtctgcaccgtatctctgacagaatgctccgcattcctgacttccatcaaagcatgcgacgctgccatgtgctatggctccaccaccgcaaacctagtccggggtcagaataccatacacatcgtcggaaaaggaggtcactccggatctaaattcatgtgttgccacgatacgaaatgctcgtccacagggctagtggcagcagcaccccacttggaccgagtcaccggctacaaccaggccgactccgacaaaatattcgacgacggcgcccccgaatgcgggatgagctgctggtttaagaagtccggcgaatggattcttggcgtcctgaacggaaactggatggtagttgcagtcttagtcgtcctcctcatactctcaatactactcttcaccctttgctgtccccgccgaccatcgtaccgaaaagagcataagccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16820 - RNA, 1684 nt, synthetic construct
  misc_feature 1..1684: note = mRNA product Design2 comprising derived and/or modified sequence from PUUV(K27)__L08804.1__N (wt)
  source 1..1684: mol_type = other RNA
ggggcgctgcctacggaggtggcagccatctccttctcggcatcaagcttaccatgagtgacttgacagacatccaagaggagataacccgccatgagcaacaacttgttgttgccagacaaaaactcaaggatgcagagagagcagtggaagtgtacccggatgacgttatcaagaacacattacaagcaagacaacaaacagtgtcagcactggaggataaactcgcagactacaagagaagaatggcagatgctgtgtcccggaagaaaatggatactaaacctactgacccgactgggattgaacctgatgatcatctcaaggagagatcaagccttagatatggaaatgtccttgatgtgaatgctattgacattgaagaaccaagtggccagacagcagattggtatactatcggagtctatgtaatagggttcacaattcctatcattttgaaggctctatatatgttgtcaacacgtggaagacagactgtaaaggaaaacaaaggaacacggatcaggttcaaggatgacacatcatttgaggatatcaatggcatcaggagaccaaaacacctatatgtatccatgcctactgcccagtccaccatgaaagctgaagaacttacacctggacggttccgtacaatagtatgtggcttattccctacacagatacaagttcgtaacatcatgagtccagtaatgggagtgattggtttttctttcttcgttaaagactggccagaaaaaattagggagtttatggagaaagaatgccctttcataaagccagaagttaaacctgggacaccagcacaggaggtagaatttttgaaaagaaatagagtttacttcatgacccgccaggatgttcttgacaaaaatcatgtggctgacatcgataagttgattgactatgctgcctctggtgaccctacatcgcctgatgacatcaaatctcctaatgcaccatgggtatttgcttgtgcaccagatcggtcgcccccaacatgtatttatgttgctgggatggctgaattaggtgcattcttttccatcttacaggatatgaggaacaccattatggcatctaaaactgtgggcacagcagaagagaaactgaaaaggaagtcctccttctatcaatcatatttgcgccgaacacaatcaatggggattcaacttgatcagaggataatcctactgtacatgttggaatggggaaaagaaatggtggatcatttccatcttggtgatgacatggatcctgagctaaggggccttgctcagtcactcatagaccagaaggtaaaagagatatcaaaccaagaacccttaaagatatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16821 - RNA, 3829 nt, synthetic construct
  misc_feature 1..3829: note = mRNA product Design2 comprising derived and/or modified sequence from PUUV(K27)__L08754.1__GP (wt)
  source 1..3829: mol_type = other RNA
ggggcgctgcctacggaggtggcagccatctccttctcggcatcaagcttaccatgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16822 - RNA, 3829 nt, synthetic construct
  misc_feature 1..3829: note = mRNA product Design2 comprising derived and/or modified sequence from PUUV(K27)__L08754.1__GP (wt)
  source 1..3829: mol_type = other RNA
ggggcgctgcctacggaggtggcagccatctccttctcggcatcaagcttaccatgggagaacttagtccagtttgtctgtatctgcttctccagggtctattactatgtaatacaggggctgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcatactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttacaagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16823 - RNA, 3814 nt, synthetic construct
  misc_feature 1..3814: note = mRNA product Design2 comprising derived and/or modified sequence from PUUV(K27)__L08754.1__IgE-leader_Gn-Gc (wt)
  source 1..3814: mol_type = other RNA
ggggcgctgcctacggaggtggcagccatctccttctcggcatcaagcttaccatggactggacctggatcctgttcctcgtggccgccgcgacccgcgtccacagcgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcttactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttactagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16824 - RNA, 3814 nt, synthetic construct
  misc_feature 1..3814: note = mRNA product Design2 comprising derived and/or modified sequence from PUUV(K27)__L08754.1__IgE-leader_Gn-Gc (wt)
  source 1..3814: mol_type = other RNA
ggggcgctgcctacggaggtggcagccatctccttctcggcatcaagcttaccatggactggacctggatcctgttcctcgtggccgccgcgacccgcgtccacagcgccagaaaccttaatgagcttaaaatggaatgtccacatactattagattagggcagggtcttgttgtgggttcagtagaattgccatctcttccaatacagcaggtcgagacactaaagctggagagttcttgtaattttgatctacataccagtacagcaggacaacaatcattcacaaaatggacatgggaaattaaaggtgatcttgcagagaacacacaggcatcatcaacaagttttcaaacaaaaagcagtgaagtgaatttgagaggattatgtttgatccctactttagtggttgaaacagcagcaagaatgcgaaaaacaatagcatgttatgacctgtcatgcaatcaaacagtgtgtcagcctactgtctatttaatgggacctatccagacttgtataacaactaaaagttgtctcctgagtttaggtgatcaaaggattcaagtaaattatgaaaaaacatactgtgtttctgggcagcttgttgaaggtatctgttttaatccaatacatacaatggcactctctcaacctagtcatacatatgatataatgaccatgatggttcgctgtttcttggtaataaagaaagtgacttctggtgacagtatgaagattgaaaagaactttgagactcttgttcaaaaaaatggctgcacagctaataacttccaagggtattatatctgtcttatagggagtagttcagagcccctatatgttccagcattagatgattatcgttcagctgaagttctttcaaggatggcatttgcaccacatggtgaagatcatgatattgagaaaaatgcagtgagtgcaatgcgtattgctggaaaggtgacaggaaaggcgccatcaacagaatcatcagatacagtacaggggattgcattttcaggtagtcctctttatacatctactggtgtcttgacatcaaaagatgatcctgtctacatttgggctcctggaatcataatggaaggaaaccattctatttgtgaaaagaagaccttaccccttacatggactggttttatttcattgcctggagagattgaaaaaacaacacaatgtacagtattttgtacattggctggaccaggtgcagattgtgaagcatactctgaaacaggcatcttcaacataagttcacctacttgctcaataaatcgtgtccagagattccgtggttcagaacagcaaataaagtttgtgtgccagagagtggacatggatatcactgtttactgtaatgggatgaagaaagtcattctcaccaagaccctagttattggacaatgcatttatacttttacaagtattttctctctaatccctggtgttgcacattcccttgctgttgaattatgtgtacctggtcttcatggttgggcaactatgctattattactaacactttgttttggctgggtcttaataccaactataacaatgatcctgctaaagatattgattgcattcgcatacttatgttctaaatataacacagattcgaaattcaggatcttgattgagaaagtgaaaagagagtaccagaaaacaatgggttcaatggtttgtgaagtgtgtcagtatgaatgtgagactgcaaaagaactggagtcacatagaaagagttgttccattggttcatgcccttattgtctcaatccatctgaggcaacaacatctgcccttcaggctcattttaaagtgtgtaagctcacatcacggtttcaggagaatttaagaaagtcattaacggtatatgagcctatgcaagggtgctaccggactttatccctctttagatataggagtcggttctttgtgggtctagtctggtgcgtgttattggttctagagttaattgtatgggctgccagtgctgaaacacaaaatttaaatgcaggttggacagacacagcacatggatctggaattatacctatgaaaactgatctggaattagacttctctcttccgtcatcagcaagctatacatataggagacagctacaaaacccagcaaacgaacaagagaaaatcccatttcatctgcagttaagcaaacaagtgattcatgcagagatccagcatttaggtcattggatggatgctacatttaatcttaaaactgcatttcactgctatggctcatgtgagaagtatgcttatccttggcagacagcaggttgtttcatagaaaaagattatgaatatgagactggttggggttgtaatccacctgattgcccaggggtagggacaggctgtactgcttgtggggtataccttgataaattaaaatcagttggaaaggttttcaaaattgtgtccttaagatacacaaggaaagtatgcattcagttgggcacagaacaaacatgtaagactgttgatagtaatgactgtctcattaccacttcagttaaagtgtgcttgatagggaccatatcaaaattccaaccatctgacactttgctatttctaggtccactacagcagggtggtctgatatttaaacaatggtgcactacaacatgccagtttggcgatcccggggacataatgagcacacctacaggcatgaagtgcccagaattaaatggttcttttagaaagaaatgtgcatttgcaacaactccagtttgccagtttgatggaaatacaatttcaggctataagaggatgattgccacaaaggattcatttcaatctttcaatgtgacagaaccccatatttctacaagtgcacttgaatggattgatcctgacagctcacttagggaccatattaatgtaattgtgagtcgtgatctatccttccaagacctaagtgaaacaccatgtcaaattgatttagcaacagcctctatagatggagcatggggttcaggagttggttttaatctggtttgtactgttagtttaacagaatgttctgcatttctgacatcaatcaaggcctgtgatgctgcaatgtgttatgggtccaccacagccaatctagttcgagggcaaaataccattcatatcgtcggtaagggtgggcattctggttcaaaatttatgtgttgtcatgacacaaaatgttctagcaccggtctagttgcagctgcaccacacttagatcgtgtgacaggatacaatcaggctgatagtgacaaaatctttgatgatggggcaccagaatgtggtatgtcatgttggtttaaaaaatcaggtgaatggattcttggggttttgaacgggaattggatggttgttgctgtactggtagtattactgatcttgtccatactcttattcacattatgttgtcctcgtagacctagttacaggaaagaacataagccctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16825 - RNA, 1684 nt, synthetic construct
  misc_feature 1..1684: note = mRNA product Design2 comprising derived and/or modified sequence from PUUV(K27)__L08804.1__N (opt4)
  source 1..1684: mol_type = other RNA
ggggcgctgcctacggaggtggcagccatctccttctcggcatcaagcttaccatgagcgacctgaccgacatccaggaggagatcaccagacacgagcagcagctggtggtggccagacagaagctgaaggacgccgagagagccgtggaggtgtaccccgacgacgtgatcaagaacaccctgcaggccagacagcagaccgtgagcgccctggaggacaagctggccgactacaagagaagaatggccgacgccgtgagcagaaagaagatggacaccaagcccaccgaccccaccggcatcgagcccgacgaccacctgaaggagagaagcagcctgagatacggcaacgtgctggacgtgaacgccatcgacatcgaggagcccagcggccagaccgccgactggtacaccatcggcgtgtacgtgatcggcttcaccatccccatcatcctgaaggccctgtacatgctgagcaccagaggcagacagaccgtgaaggagaacaagggcaccagaatcagattcaaggacgacaccagcttcgaggacatcaacggcatcagaagacccaagcacctgtacgtgagcatgcccaccgcccagagcaccatgaaggccgaggagctgacccccggcagattcagaaccatcgtgtgcggcctgttccccacccagatccaggtgagaaacatcatgagccccgtgatgggcgtgatcggcttcagcttcttcgtgaaggactggcccgagaagatcagagagttcatggagaaggagtgccccttcatcaagcccgaggtgaagcccggcacccccgcccaggaggtggagttcctgaagagaaacagagtgtacttcatgaccagacaggacgtgctggacaagaaccacgtggccgacatcgacaagctgatcgactacgccgccagcggcgaccccaccagccccgacgacatcaagagccccaacgccccctgggtgttcgcctgcgcccccgacagaagcccccccacctgcatctacgtggccggcatggccgagctgggcgccttcttcagcatcctgcaggacatgagaaacaccatcatggccagcaagaccgtgggcaccgccgaggagaagctgaagagaaagagcagcttctaccagagctacctgagaagaacccagagcatgggcatccagctggaccagagaatcatcctgctgtacatgctggagtggggcaaggagatggtggaccacttccacctgggcgacgacatggaccccgagctgagaggcctggcccagagcctgatcgaccagaaggtgaaggagatcagcaaccaggagcccctgaagatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16826 - RNA, 3829 nt, synthetic construct
  misc_feature 1..3829: note = mRNA product Design2 comprising derived and/or modified sequence from PUUV(K27)__L08754.1__GP (opt4)
  source 1..3829: mol_type = other RNA
ggggcgctgcctacggaggtggcagccatctccttctcggcatcaagcttaccatgggcgagctgagccccgtgtgcctgtacctgctgctgcagggcctgctgctgtgcaacaccggcgccgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcagcatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccctgtgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16827 - RNA, 3814 nt, synthetic construct
  misc_feature 1..3814: note = mRNA product Design2 comprising derived and/or modified sequence from PUUV(K27)__L08754.1__IgE-leader_Gn-Gc (opt4)
  source 1..3814: mol_type = other RNA
ggggcgctgcctacggaggtggcagccatctccttctcggcatcaagcttaccatggactggacctggatcctgttcctggtggccgccgccaccagagtgcacagcgccagaaacctgaacgagctgaagatggagtgcccccacaccatcagactgggccagggcctggtggtgggcagcgtggagctgcccagcctgcccatccagcaggtggagaccctgaagctggagagcagctgcaacttcgacctgcacaccagcaccgccggccagcagagcttcaccaagtggacctgggagatcaagggcgacctggccgagaacacccaggccagcagcaccagcttccagaccaagagcagcgaggtgaacctgagaggcctgtgcctgatccccaccctggtggtggagaccgccgccagaatgagaaagaccatcgcctgctacgacctgagctgcaaccagaccgtgtgccagcccaccgtgtacctgatgggccccatccagacctgcatcaccaccaagagctgcctgctgagcctgggcgaccagagaatccaggtgaactacgagaagacctactgcgtgagcggccagctggtggagggcatctgcttcaaccccatccacaccatggccctgagccagcccagccacacctacgacatcatgaccatgatggtgagatgcttcctggtgatcaagaaggtgaccagcggcgacagcatgaagatcgagaagaacttcgagaccctggtgcagaagaacggctgcaccgccaacaacttccagggctactacatctgcctgatcggcagcagcagcgagcccctgtacgtgcccgccctggacgactacagaagcgccgaggtgctgagcagaatggccttcgccccccacggcgaggaccacgacatcgagaagaacgccgtgagcgccatgagaatcgccggcaaggtgaccggcaaggcccccagcaccgagagcagcgacaccgtgcagggcatcgccttcagcggcagccccctgtacaccagcaccggcgtgctgaccagcaaggacgaccccgtgtacatctgggcccccggcatcatcatggagggcaaccacagcatctgcgagaagaagaccctgcccctgacctggaccggcttcatcagcctgcccggcgagatcgagaagaccacccagtgcaccgtgttctgcaccctggccggccccggcgccgactgcgaggcctacagcgagaccggcatcttcaacatcagcagccccacctgcagcatcaacagagtgcagagattcagaggcagcgagcagcagatcaagttcgtgtgccagagagtggacatggacatcaccgtgtactgcaacggcatgaagaaggtgatcctgaccaagaccctggtgatcggccagtgcatctacaccttcaccagcatcttcagcctgatccccggcgtggcccacagcctggccgtggagctgtgcgtgcccggcctgcacggctgggccaccatgctgctgctgctgaccctgtgcttcggctgggtgctgatccccaccatcaccatgatcctgctgaagatcctgatcgccttcgcctacctgtgcagcaagtacaacaccgacagcaagttcagaatcctgatcgagaaggtgaagagagagtaccagaagaccatgggcagcatggtgtgcgaggtgtgccagtacgagtgcgagaccgccaaggagctggagagccacagaaagagctgcagcatcggcagctgcccctactgcctgaaccccagcgaggccaccaccagcgccctgcaggcccacttcaaggtgtgcaagctgaccagcagattccaggagaacctgagaaagagcctgaccgtgtacgagcccatgcagggctgctacagaaccctgagcctgttcagatacagaagcagattcttcgtgggcctggtgtggtgcgtgctgctggtgctggagctgatcgtgtgggccgccagcgccgagacccagaacctgaacgccggctggaccgacaccgcccacggcagcggcatcatccccatgaagaccgacctggagctggacttcagcctgcccagcagcgccagctacacctacagaagacagctgcagaaccccgccaacgagcaggagaagatccccttccacctgcagctgagcaagcaggtgatccacgccgagatccagcacctgggccactggatggacgccaccttcaacctgaagaccgccttccactgctacggcagctgcgagaagtacgcctacccctggcagaccgccggctgcttcatcgagaaggactacgagtacgagaccggctggggctgcaacccccccgactgccccggcgtgggcaccggctgcaccgcctgcggcgtgtacctggacaagctgaagagcgtgggcaaggtgttcaagatcgtgagcctgagatacaccagaaaggtgtgcatccagctgggcaccgagcagacctgcaagaccgtggacagcaacgactgcctgatcaccaccagcgtgaaggtgtgcctgatcggcaccatcagcaagttccagcccagcgacaccctgctgttcctgggccccctgcagcagggcggcctgatcttcaagcagtggtgcaccaccacctgccagttcggcgaccccggcgacatcatgagcacccccaccggcatgaagtgccccgagctgaacggcagcttcagaaagaagtgcgccttcgccaccacccccgtgtgccagttcgacggcaacaccatcagcggctacaagagaatgatcgccaccaaggacagcttccagagcttcaacgtgaccgagccccacatcagcaccagcgccctggagtggatcgaccccgacagcagcctgagagaccacatcaacgtgatcgtgagcagagacctgagcttccaggacctgagcgagaccccctgccagatcgacctggccaccgccagcatcgacggcgcctggggcagcggcgtgggcttcaacctggtgtgcaccgtgagcctgaccgagtgcagcgccttcctgaccagcatcaaggcctgcgacgccgccatgtgctacggcagcaccaccgccaacctggtgagaggccagaacaccatccacatcgtgggcaagggcggccacagcggcagcaagttcatgtgctgccacgacaccaagtgcagcagcaccggcctggtggccgccgccccccacctggacagagtgaccggctacaaccaggccgacagcgacaagatcttcgacgacggcgcccccgagtgcggcatgagctgctggttcaagaagagcggcgagtggatcctgggcgtgctgaacggcaactggatggtggtggccgtgctggtggtgctgctgatcctgagcatcctgctgttcaccctgtgctgccccagaagacccagctacagaaaggagcacaagccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16828 - RNA, 1684 nt, synthetic construct
  misc_feature 1..1684: note = mRNA product Design2 comprising derived and/or modified sequence from PUUV(K27)__L08804.1__N (opt3)
  source 1..1684: mol_type = other RNA
ggggcgctgcctacggaggtggcagccatctccttctcggcatcaagcttaccatgagcgacctgaccgatatccaggaggaaattacaagacacgagcaacagctcgtggtcgccaggcagaaacttaaagacgctgaacgggcagttgaggtgtaccccgatgacgtaataaagaacactctgcaggcccgccaacagacggtgtccgcgttggaagataaattagctgactataagcgacgtatggccgatgcagtctctagaaagaagatggacaccaagcctacagatccaactggcatcgagccggacgatcatctgaaagagaggtcaagtctacggtacgggaatgtgctcgacgttaacgccattgatatcgaagaacccagcggacagaccgctgactggtatacaattggtgtgtacgtcatcggcttcaccatacctatcattctgaaggcactttatatgctgtccactcgcgggagacagacagtgaaagaaaataagggaaccaggatccggtttaaagacgatacgtctttcgaggacattaacggcatccgccgaccaaagcacttgtacgtatcgatgcccactgcccaatcaaccatgaaggctgaggaactcacacctggtagatttaggactatagtttgcgggctgttcccaacccagattcaggtgcggaatatcatgagccccgtcatgggagtgattggctttagtttctttgtgaaagattggcctgagaagatccgtgagttcatggagaaagaatgtccatttatcaagccggaggtcaaacccggcacccctgcccaggaggttgagttcctgaagcgcaacagagtgtattttatgacaaggcaagacgtactcgataaaaatcatgtggcggacattgataagttaatagactacgcagcctccggggatccaacgtctcccgacgatatcaagagccctaacgctccatgggtcttcgcctgcgcacccgaccggtccccgcctacttgtatttacgtggctggaatggccgaactgggtgcgtttttctcaatccttcaggacatgcgaaatacaataatggccagtaaaaccgttggcactgcagaagagaagttgaaacgcaagagctctttctatcagtcctacctgagaaggacacaatcaatggggattcagctagatcagcggatcatcctcctgtatatgcttgaatggggaaaagagatggtggaccactttcatctgggcgatgacatggatcccgagttgcgcggtctcgctcagagcctgattgaccaaaaggtcaaggaaatcagtaaccaggagccattaaaaatttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16829 - RNA, 3829 nt, synthetic construct
  misc_feature 1..3829: note = mRNA product Design2 comprising derived and/or modified sequence from PUUV(K27)__L08754.1__GP (opt3)
  source 1..3829: mol_type = other RNA
ggggcgctgcctacggaggtggcagccatctccttctcggcatcaagcttaccatgggcgagctgagccccgtgtgcctctaccttctgttgcaggggttactgctatgtaacaccggagccgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgctccattaacagagttcagaggttccggggaagcgagcaacagatcaagtttgtgtgtcagcgcgtcgacatggacatcacagtgtactgcaacggcatgaaaaaggtaattctgaccaagactttggttatcggtcagtgtatttataccttcacatctatattctcactcatccccggggtggcccacagtctggcagtcgagttatgcgtgccgggcctgcatggatgggctaccatgctactcctgcttactttgtgttttggctgggtcctgattcctacaatcacgatgatcctcctgaaaattcttatagccttcgcttacctgtgcagcaagtataataccgattccaaatttcgaatcttgattgaaaaggtgaaaagagagtaccaaaagactatggggtctatggtttgcgaagtgtgtcagtacgagtgcgaaacagccaaggagctcgagtcgcacaggaaaagctgttccatcggatcatgcccctattgtctgaacccaagtgaagcaaccacatctgccttacaggctcatttcaaggtatgcaaactgactagccggtttcaggagaatctacgtaagtccctcaccgtctacgaacctatgcaaggttgttatcgcacgctgtcacttttcagatacaggagccggtttttcgtgggcttggtttggtgcgtgctgctcgtcctggagttaattgtgtgggcggcatctgccgagacccagaacctgaatgctgggtggacagacactgcccacggatccggcatcatacccatgaaaaccgatcttgaattggactttagtctcccaagctctgcatcctatacataccgacgccagctgcagaaccccgccaatgagcaagaaaagatccctttccacctacagctgtcaaagcaggtaattcatgctgagatccaacacctcggtcattggatggatgccacttttaacctgaaaaccgcattccactgttatgggagttgcgaaaagtacgcgtacccatggcagacggctggctgttttattgagaaagactatgagtacgaaacaggatggggctgcaatccgcccgattgccctggggtgggaaccggttgtactgcctgcggcgtttatcttgacaagttgaaaagcgtcgggaaggtgttcaagatcgtgtcgctgagatacacaaggaaagtctgtatacagttaggaaccgagcagacttgcaagaccgttgattccaacgactgtctcattacaacgtctgtgaaagtgtgcctgatcggcaccattagcaagttccaaccatcagatactcttctgtttttgggtcccctccagcaagggggcctgatcttcaaacagtggtgtacaaccacatgccagtttggagaccctggcgacataatgagtactccaaccgggatgaagtgtcccgaactaaatggatccttccggaaaaagtgcgcatttgccacgacaccggtatgtcagttcgatggcaacaccatctctggttataagcgcatgattgctactaaagacagctttcagtccttcaatgtcaccgagcctcatatctcaacaagcgccctggaatggattgatccagacagttctctcagagatcacatcaacgtgatagtttccagggacctgagctttcaggatctttcggagactccctgccaaattgacttggcaaccgcttcaatcgatggggcctggggatctggcgtgggtttcaatctggtctgcacagtgagtttaacggagtgttccgcgtttctcaccagcatcaaggcctgcgacgctgcaatgtgttacggctctactacagccaacctggttcgtgggcagaacaccattcacatcgtgggaaaaggcgggcatagcggatccaagttcatgtgctgtcacgatactaaatgctcaagtacaggccttgtagctgccgcacctcatctggaccgggtcaccggttataatcaggcggatagcgacaagatttttgacgatggggcccccgaatgtggaatgtcttgctggttcaagaaatccggcgagtggatactaggtgtgctcaacggcaattggatggtggtcgctgttctggtggtattgctgatcttatcaattctcctgttcacgctttgttgcccacgaagacctagttacaggaaggaacacaaaccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16830 - RNA, 3814 nt, synthetic construct
  misc_feature 1..3814: note = mRNA product Design2 comprising derived and/or modified sequence from PUUV(K27)__L08754.1__IgE-leader_Gn-Gc (opt3)
  source 1..3814: mol_type = other RNA
ggggcgctgcctacggaggtggcagccatctccttctcggcatcaagcttaccatggactggacctggatcctgttcctcgtggccgctgcaacaagagtccacagcgctagaaatctcaacgaactgaagatggagtgccctcacacaatcaggcttggtcaaggcctggtcgttgggtccgtggaattgccatctctcccgattcagcaggtagagactctgaaactggaatcaagttgtaatttcgacctccatacgagcaccgcaggacagcaatcctttacaaagtggacttgggagataaaaggcgatttagccgagaacacccaggcgtcttcgacatcattccagaccaagagcagtgaagtgaatctgcggggtctttgcttgatccccactctggtcgtggagacagctgcccgcatgcgaaaaaccattgcatgttatgacctatcctgcaaccagacggtttgtcaacctactgtgtacctcatggggccaatccagacctgcattacaactaagtcttgtctgcttagcctgggagatcagcgtatccaggtcaattatgaaaagacctactgcgtgtccggccaattggtagagggcatatgttttaaccccatccacacaatggccctctcacagcctagtcatacctatgacattatgacgatgatggttagatgcttcctggtgatcaaaaaggtcactagcggggattctatgaaaattgagaagaattttgaaacattagtgcagaaaaacggatgcaccgctaataacttccaaggttactatatctgtctgataggctcctcaagcgagccactctacgtgcccgcacttgacgattacaggagtgccgaagtcctgtctcggatggcttttgcccctcacggggaggaccatgatattgaaaagaatgcggtttccgcaatgcgcatcgccggaaaggtgactggcaaagctccaagcacagagtcgtctgacaccgtacagggtattgccttctccgggtcaccgttgtatacgagtaccggagtgctaacaagcaaggatgaccccgtctacatctgggcacctggcatcattatggagggcaaccactccatatgcgagaaaaagactctgccactcacctggacagggtttatctctctgcccggagaaattgagaaaactacccagtgtacagtgttctgcacccttgctggtcctggcgccgattgtgaagcgtatagcgaaactgggatctttaatatatcaagtccaacgtgctccattaacagagttcagaggttccggggaagcgagcaacagatcaagtttgtgtgtcagcgcgtcgacatggacatcacagtgtactgcaacggcatgaaaaaggtaattctgaccaagactttggttatcggtcagtgtatttataccttcacatctatattctcactcatccccggggtggcccacagtctggcagtcgagttatgcgtgccgggcctgcatggatgggctaccatgctactcctgcttactttgtgttttggctgggtcctgattcctacaatcacgatgatcctcctgaaaattcttatagccttcgcttacctgtgcagcaagtataataccgattccaaatttcgaatcttgattgaaaaggtgaaaagagagtaccaaaagactatggggtctatggtttgcgaagtgtgtcagtacgagtgcgaaacagccaaggagctcgagtcgcacaggaaaagctgttccatcggatcatgcccctattgtctgaacccaagtgaagcaaccacatctgccttacaggctcatttcaaggtatgcaaactgactagccggtttcaggagaatctacgtaagtccctcaccgtctacgaacctatgcaaggttgttatcgcacgctgtcacttttcagatacaggagccggtttttcgtgggcttggtttggtgcgtgctgctcgtcctggagttaattgtgtgggcggcatctgccgagacccagaacctgaatgctgggtggacagacactgcccacggatccggcatcatacccatgaaaaccgatcttgaattggactttagtctcccaagctctgcatcctatacataccgacgccagctgcagaaccccgccaatgagcaagaaaagatccctttccacctacagctgtcaaagcaggtaattcatgctgagatccaacacctcggtcattggatggatgccacttttaacctgaaaaccgcattccactgttatgggagttgcgaaaagtacgcgtacccatggcagacggctggctgttttattgagaaagactatgagtacgaaacaggatggggctgcaatccgcccgattgccctggggtgggaaccggttgtactgcctgcggcgtttatcttgacaagttgaaaagcgtcgggaaggtgttcaagatcgtgtcgctgagatacacaaggaaagtctgtatacagttaggaaccgagcagacttgcaagaccgttgattccaacgactgtctcattacaacgtctgtgaaagtgtgcctgatcggcaccattagcaagttccaaccatcagatactcttctgtttttgggtcccctccagcaagggggcctgatcttcaaacagtggtgtacaaccacatgccagtttggagaccctggcgacataatgagtactccaaccgggatgaagtgtcccgaactaaatggatccttccggaaaaagtgcgcatttgccacgacaccggtatgtcagttcgatggcaacaccatctctggttataagcgcatgattgctactaaagacagctttcagtccttcaatgtcaccgagcctcatatctcaacaagcgccctggaatggattgatccagacagttctctcagagatcacatcaacgtgatagtttccagggacctgagctttcaggatctttcggagactccctgccaaattgacttggcaaccgcttcaatcgatggggcctggggatctggcgtgggtttcaatctggtctgcacagtgagtttaacggagtgttccgcgtttctcaccagcatcaaggcctgcgacgctgcaatgtgttacggctctactacagccaacctggttcgtgggcagaacaccattcacatcgtgggaaaaggcgggcatagcggatccaagttcatgtgctgtcacgatactaaatgctcaagtacaggccttgtagctgccgcacctcatctggaccgggtcaccggttataatcaggcggatagcgacaagatttttgacgatggggcccccgaatgtggaatgtcttgctggttcaagaaatccggcgagtggatactaggtgtgctcaacggcaattggatggtggtcgctgttctggtggtattgctgatcttatcaattctcctgttcacgctttgttgcccacgaagacctagttacaggaaggaacacaaaccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16831 - RNA, 1684 nt, synthetic construct
  misc_feature 1..1684: note = mRNA product Design2 comprising derived and/or modified sequence from PUUV(K27)__L08804.1__N (opt1)
  source 1..1684: mol_type = other RNA
ggggcgctgcctacggaggtggcagccatctccttctcggcatcaagcttaccatgagcgacctgaccgacatccaggaggagatcacccgccacgagcagcagctcgtggtcgcccggcagaagctgaaggacgccgagcgcgcggtggaggtgtaccccgacgacgtcatcaagaacacgctgcaggcccggcagcagaccgtgtccgccctcgaggacaagctggccgactacaagcgccggatggccgacgcggtgagccgcaagaagatggacaccaagccgaccgaccccacgggcatcgagcccgacgaccacctgaaggagcggtccagcctccgctacgggaacgtcctggacgtgaacgccatcgacatcgaggagccctccggccagaccgccgactggtacaccatcggggtgtacgtcatcggcttcaccatcccgatcatcctgaaggccctctacatgctgagcacgcgggggcgccagaccgtgaaggagaacaagggcacccggatccgcttcaaggacgacacctccttcgaggacatcaacggcatccggcgccccaagcacctgtacgtgagcatgcccacggcgcagtccaccatgaaggccgaggagctcacccccgggcggttccgcaccatcgtctgcggcctgttcccgacgcagatccaggtgcggaacatcatgagccccgtgatgggggtcatcggcttctccttcttcgtgaaggactggcccgagaagatccgcgagttcatggagaaggagtgccccttcatcaagccggaggtgaagcccgggacccccgcccaggaggtcgagttcctgaagcggaaccgcgtgtacttcatgacccggcaggacgtgctcgacaagaaccacgtcgccgacatcgacaagctgatcgactacgccgcgagcggcgaccccacctccccggacgacatcaagagccccaacgccccctgggtgttcgcctgcgcccccgaccgctccccgcccacgtgcatctacgtggccggcatggcggagctgggggccttcttcagcatcctccaggacatgcgcaacaccatcatggcctccaagaccgtcggcaccgccgaggagaagctgaagcgcaagagctccttctaccagagctacctgcggcggacgcagagcatggggatccagctcgaccagcgcatcatcctgctgtacatgctcgagtggggcaaggagatggtggaccacttccacctgggcgacgacatggaccccgagctgcgggggctcgcccagtccctgatcgaccagaaggtcaaggagatcagcaaccaggagcccctgaagatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16832 - RNA, 3829 nt, synthetic construct
  misc_feature 1..3829: note = mRNA product Design2 comprising derived and/or modified sequence from PUUV(K27)__L08754.1__GP (opt1)
  source 1..3829: mol_type = other RNA
ggggcgctgcctacggaggtggcagccatctccttctcggcatcaagcttaccatgggcgagctgagccccgtgtgcctctacctgctgctccaggggctgctgctctgcaacaccggcgccgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgctccatcaaccgcgtccagcggttccgcggcagcgagcagcagatcaagttcgtgtgccagcgggtcgacatggacatcaccgtgtactgcaacgggatgaagaaggtgatcctgaccaagaccctggtcatcggccagtgcatctacacgttcacctccatcttcagcctcatccccggcgtggcccacagcctggccgtggagctgtgcgtccccgggctccacggctgggccaccatgctgctgctcctgaccctgtgcttcgggtgggtgctgatccccacgatcaccatgatcctcctgaagatcctgatcgcgttcgcctacctctgctccaagtacaacaccgacagcaagttccgcatcctgatcgagaaggtgaagcgggagtaccagaagaccatgggctccatggtctgcgaggtgtgccagtacgagtgcgagacggccaaggagctggagagccaccgcaagtcctgcagcatcgggtcctgcccctactgcctcaaccccagcgaggccaccacctccgccctgcaggcgcacttcaaggtgtgcaagctgaccagccggttccaggagaacctccgcaagtccctgacggtctacgagccgatgcagggctgctaccggaccctgagcctcttccgctaccggtcccgcttcttcgtgggcctggtgtggtgcgtcctgctcgtgctggagctgatcgtgtgggccgccagcgccgagacccagaacctcaacgcggggtggaccgacacggcccacggctccgggatcatccccatgaagaccgacctggagctggacttcagcctcccctccagcgccagctacacctaccgccggcagctgcagaaccccgccaacgagcaggagaagatcccgttccacctccagctctccaagcaggtcatccacgccgagatccagcacctgggccactggatggacgcgaccttcaacctgaagacggccttccactgctacggcagctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctgaagtccgtcgggaaggtgttcaagatcgtgagcctgcgctacacccggaaggtctgcatccagctcggcaccgagcagacctgcaagacggtggactccaacgactgcctgatcaccaccagcgtgaaggtctgcctgatcgggaccatctccaagttccagcccagcgacacgctcctgttcctgggccccctccagcagggcgggctgatcttcaagcagtggtgcaccacgacctgccagttcggcgacccgggggacatcatgtccacccccaccggcatgaagtgccccgagctgaacgggagcttccgcaagaagtgcgcgttcgccaccacccccgtgtgccagttcgacggcaacaccatctccgggtacaagcggatgatcgccacgaaggacagcttccagtccttcaacgtgaccgagccgcacatcagcacctccgccctcgagtggatcgaccccgacagctccctgcgcgaccacatcaacgtcatcgtgagccgggacctgtccttccaggacctcagcgagaccccctgccagatcgacctggccacggcgagcatcgacggcgcctggggctccggggtgggcttcaacctggtctgcaccgtgagcctcaccgagtgctccgccttcctgaccagcatcaaggcctgcgacgcggccatgtgctacgggtccacgaccgccaacctggtgcgcggccagaacaccatccacatcgtcgggaagggcggccacagcgggtccaagttcatgtgctgccacgacaccaagtgcagctccacgggcctcgtggccgccgcgccccacctggaccgggtgaccgggtacaaccaggccgacagcgacaagatcttcgacgacggcgccccggagtgcggcatgtcctgctggttcaagaagtccggggagtggatcctgggcgtcctcaacgggaactggatggtggtggccgtcctggtggtgctgctcatcctgagcatcctgctgttcaccctgtgctgcccccgccggcccagctaccgcaaggagcacaagccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16833 - RNA, 3814 nt, synthetic construct
  misc_feature 1..3814: note = mRNA product Design2 comprising derived and/or modified sequence from PUUV(K27)__L08754.1__IgE-leader_Gn-Gc (opt1)
  source 1..3814: mol_type = other RNA
ggggcgctgcctacggaggtggcagccatctccttctcggcatcaagcttaccatggactggacctggatcctgttcctcgtggccgccgcgacccgcgtccacagcgcccgcaacctgaacgagctgaagatggagtgcccgcacaccatccggctcgggcagggcctggtcgtggggtccgtggagctgcccagcctccccatccagcaggtcgagacgctgaagctggagtccagctgcaacttcgacctccacacctccaccgcgggccagcagagcttcaccaagtggacgtgggagatcaagggcgacctggccgagaacacccaggcctccagcacctccttccagaccaagagctccgaggtgaacctgcgcgggctctgcctgatccccacgctggtggtcgagaccgccgcccggatgcgcaagaccatcgcgtgctacgacctcagctgcaaccagaccgtgtgccagccgacggtgtacctgatgggccccatccagacctgcatcaccaccaagtcctgcctgctcagcctgggggaccagcggatccaggtcaactacgagaagacgtactgcgtgtccggccagctggtggaggggatctgcttcaaccccatccacaccatggccctcagccagccctcccacacctacgacatcatgaccatgatggtccgctgcttcctggtgatcaagaaggtgacgagcggcgactccatgaagatcgagaagaacttcgagaccctggtccagaagaacggctgcaccgccaacaacttccaggggtactacatctgcctcatcggcagcagctccgagccgctgtacgtgcccgccctggacgactaccggagcgcggaggtgctctcccgcatggccttcgcgccccacggggaggaccacgacatcgagaagaacgccgtcagcgccatgcggatcgccggcaaggtgaccggcaaggccccctccacggagagctccgacaccgtgcaggggatcgccttcagcggctccccgctgtacaccagcaccggggtcctgacgtccaaggacgaccccgtgtacatctgggcccccggcatcatcatggaggggaaccacagcatctgcgagaagaagaccctccccctgacctggaccggcttcatctccctgccgggcgagatcgagaagacgacccagtgcaccgtgttctgcaccctcgccgggcccggcgcggactgcgaggcctacagcgagacggggatcttcaacatctccagcccgacctgctccatcaaccgcgtccagcggttccgcggcagcgagcagcagatcaagttcgtgtgccagcgggtcgacatggacatcaccgtgtactgcaacgggatgaagaaggtgatcctgaccaagaccctggtcatcggccagtgcatctacacgttcacctccatcttcagcctcatccccggcgtggcccacagcctggccgtggagctgtgcgtccccgggctccacggctgggccaccatgctgctgctcctgaccctgtgcttcgggtgggtgctgatccccacgatcaccatgatcctcctgaagatcctgatcgcgttcgcctacctctgctccaagtacaacaccgacagcaagttccgcatcctgatcgagaaggtgaagcgggagtaccagaagaccatgggctccatggtctgcgaggtgtgccagtacgagtgcgagacggccaaggagctggagagccaccgcaagtcctgcagcatcgggtcctgcccctactgcctcaaccccagcgaggccaccacctccgccctgcaggcgcacttcaaggtgtgcaagctgaccagccggttccaggagaacctccgcaagtccctgacggtctacgagccgatgcagggctgctaccggaccctgagcctcttccgctaccggtcccgcttcttcgtgggcctggtgtggtgcgtcctgctcgtgctggagctgatcgtgtgggccgccagcgccgagacccagaacctcaacgcggggtggaccgacacggcccacggctccgggatcatccccatgaagaccgacctggagctggacttcagcctcccctccagcgccagctacacctaccgccggcagctgcagaaccccgccaacgagcaggagaagatcccgttccacctccagctctccaagcaggtcatccacgccgagatccagcacctgggccactggatggacgcgaccttcaacctgaagacggccttccactgctacggcagctgcgagaagtacgcctacccctggcagaccgccgggtgcttcatcgagaaggactacgagtacgagaccggctgggggtgcaacccgcccgactgccccggcgtggggaccggctgcacggcctgcggcgtgtacctcgacaagctgaagtccgtcgggaaggtgttcaagatcgtgagcctgcgctacacccggaaggtctgcatccagctcggcaccgagcagacctgcaagacggtggactccaacgactgcctgatcaccaccagcgtgaaggtctgcctgatcgggaccatctccaagttccagcccagcgacacgctcctgttcctgggccccctccagcagggcgggctgatcttcaagcagtggtgcaccacgacctgccagttcggcgacccgggggacatcatgtccacccccaccggcatgaagtgccccgagctgaacgggagcttccgcaagaagtgcgcgttcgccaccacccccgtgtgccagttcgacggcaacaccatctccgggtacaagcggatgatcgccacgaaggacagcttccagtccttcaacgtgaccgagccgcacatcagcacctccgccctcgagtggatcgaccccgacagctccctgcgcgaccacatcaacgtcatcgtgagccgggacctgtccttccaggacctcagcgagaccccctgccagatcgacctggccacggcgagcatcgacggcgcctggggctccggggtgggcttcaacctggtctgcaccgtgagcctcaccgagtgctccgccttcctgaccagcatcaaggcctgcgacgcggccatgtgctacgggtccacgaccgccaacctggtgcgcggccagaacaccatccacatcgtcgggaagggcggccacagcgggtccaagttcatgtgctgccacgacaccaagtgcagctccacgggcctcgtggccgccgcgccccacctggaccgggtgaccgggtacaaccaggccgacagcgacaagatcttcgacgacggcgccccggagtgcggcatgtcctgctggttcaagaagtccggggagtggatcctgggcgtcctcaacgggaactggatggtggtggccgtcctggtggtgctgctcatcctgagcatcctgctgttcaccctgtgctgcccccgccggcccagctaccgcaaggagcacaagccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16834 - RNA, 1684 nt, synthetic construct
  misc_feature 1..1684: note = mRNA product Design2 comprising derived and/or modified sequence from PUUV(K27)__L08804.1__N (opt5)
  source 1..1684: mol_type = other RNA
ggggcgctgcctacggaggtggcagccatctccttctcggcatcaagcttaccatgagcgacctgaccgatatccaggaggaaattacaagacacgagcaacagctcgtggtcgcccggcagaagctgaaagacgctgaacgcgccgttgaggtgtaccccgatgacgtgatcaagaacacgcttcaggcgagacaacagaccgtctccgctctggaagataaactcgccgactataagcggcgcatggccgatgctgtgtctcggaaaaagatggacacaaagcctaccgatccgacaggcattgagcccgacgatcatctgaaagagagaagctcccttcgctacgggaatgttctggacgtgaacgccatcgatattgaagaaccttctggacagaccgctgactggtatacaatcggcgtctacgtgatcgggttcaccattcccatcattctcaaggccctgtatatgctgagcacgagaggacggcagaccgttaaagaaaataagggcacacgcatcagatttaaagacgatacctccttcgaggacattaacgggatccggcgccctaagcacctctacgtgtctatgcccacagcgcaaagcaccatgaaggccgaggaactgacgcctggaagatttcggacaattgtctgcggccttttcccgacccagatccaggtgcgcaatatcatgtcccccgtgatgggcgtcattgggtttagcttctttgttaaagattggcctgagaagatcagagagttcatggagaaagaatgtccctttattaagcctgaggtgaaacccggaacaccggctcaggaggtggagttcctgaagcggaacagagtctattttatgacccgccaagacgtgctcgataaaaatcatgttgccgacatcgataagctgattgactacgctgcctctggcgatcctacctcccccgacgatatcaagagccctaacgcgccctgggtgttcgcctgcgctcccgaccggtctcctccgacatgtatctacgtcgccgggatggctgaacttggagcctttttctccattctgcaggacatgagaaatacgatcatggccagcaaaaccgtgggcacagctgaagagaagctcaaacgcaagtcttccttctatcagagctacctgcggagaacccaatccatggggattcagctggatcagcgcatcattctcctgtatatgcttgaatggggaaaagagatggttgaccactttcatctgggcgatgacatggatcccgagctccggggcctggcgcagtctcttatcgaccaaaaggtgaaggaaatcagcaaccaggagcctctgaaaatttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16835 - RNA, 3829 nt, synthetic construct
  misc_feature 1..3829: note = mRNA product Design2 comprising derived and/or modified sequence from PUUV(K27)__L08754.1__GP (opt5)
  source 1..3829: mol_type = other RNA
ggggcgctgcctacggaggtggcagccatctccttctcggcatcaagcttaccatgggcgagctgagccccgtgtgcctctacctgcttctgcaggggctcctgctttgtaacaccggagccgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccctacctgcagcattaaccgggtgcagcgcttcagaggctctgagcaacagatcaagtttgtttgtcagcgggtggacatggacattacagtctactgcaacgggatgaaaaaggtgatcctgaccaagacgctcgtcatcggacagtgtatttataccttcacatccatcttcagcctgattcccggcgtggcccactccctggctgttgagctctgcgtgcccgggctgcatggatgggcgaccatgcttctgctcctgacactgtgttttggctgggtccttatcccgaccattacgatgatcctcctgaaaattctgatcgccttcgcttacctctgctctaagtataatacagatagcaaatttcgcatcctgattgaaaaggtgaaaagagagtaccaaaagaccatggggtccatggtttgcgaagtgtgtcagtacgagtgcgaaacagccaaggagcttgagtctcaccggaaaagctgttccatcggcagctgcccctattgtctgaacccttctgaagccaccacctccgctctccaggcccatttcaaggtctgcaaactgacaagccgctttcaggagaatctgagaaagtctcttacggtgtacgaacccatgcaaggatgttatcggaccctctccctgttcagataccgcagccggtttttcgtgggcctggtttggtgcgtcctcctggtgcttgagctgattgtgtgggcggcttctgccgagacacagaacctcaatgccgggtggaccgacacagctcacggaagcggcatcattcctatgaaaaccgatctggaactggacttttcccttcccagctctgcctcctatacgtacagacgccagctccagaacccggctaatgagcaagaaaagatccctttccatctgcagctgagcaagcaggtcatccacgccgagattcaacacctcgggcattggatggatgcgacatttaacctgaaaaccgccttccactgttatggatcctgcgaaaagtacgcttacccctggcagaccgccggctgttttatcgagaaagactatgagtacgaaacagggtggggctgcaatcctcccgattgccctggagtgggcaccgggtgtacagcttgcggagtttatcttgacaagctgaaatctgtgggcaaggtcttcaagattgtgagcctccggtacacgagaaaagtttgtatccagctggggaccgagcagacatgcaagaccgtggattccaacgactgtctgattacaacctctgtcaaagtgtgccttatcggaacgatcagcaagttccaaccctccgataccctcctgtttctgggcccgctccagcagggaggcctgattttcaaacagtggtgtacaaccacatgccaatttggagaccctggcgacatcatgtctacccccacagggatgaagtgtcccgaacttaatgggagcttccgcaaaaagtgcgcctttgcgaccacgcctgtttgtcagttcgatggcaacacaatttccgggtataagcggatgatcgccaccaaagacagctttcagtctttcaatgtgaccgagccgcatatttccacaagcgctctggaatggatcgatcccgactcttccctcagagatcacatcaacgtcattgtgagccgcgacctgtcttttcaggatctgtccgagaccccttgccaaatcgaccttgccacggctagcattgatggagcctggggctccggggtgggcttcaatctggtctgcacagttagcctcaccgagtgttctgcctttctgacaagcatcaaggcttgcgacgcggccatgtgttacggatccaccacagctaacctcgtgcggggccagaacaccattcacatcgtggggaaaggaggccattctgggagcaagttcatgtgctgtcacgatacgaaatgctcctctaccggactggtcgccgccgctccccatcttgacagagtgacaggctataatcaggccgatagcgacaagatttttgacgatggcgcgcctgaatgtgggatgtcctgctggttcaagaaatctggagagtggatcctgggcgttctcaacgggaattggatggtggtcgctgtgctggttgtgctgcttatcctgagcattctcctgttcaccctctgttgcccccgccggccttcctacagaaaggaacacaaaccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16836 - RNA, 3814 nt, synthetic construct
  misc_feature 1..3814: note = mRNA product Design2 comprising derived and/or modified sequence from PUUV(K27)__L08754.1__IgE-leader_Gn-Gc (opt5)
  source 1..3814: mol_type = other RNA
ggggcgctgcctacggaggtggcagccatctccttctcggcatcaagcttaccatggactggacctggatcctgttcctcgtggccgctgccacaagagtccacagcgctagaaatctgaacgaactcaagatggagtgccctcacacaatccggctgggccaagggctggtcgttggatccgtggaactcccgtctctgcccattcaacaggtggagacgcttaaactggaaagctcctgtaatttcgacctccatacctctacagccggccagcagagctttaccaagtggacatgggagatcaaaggggatctggcggagaacacccaggcttcctctaccagcttccagacaaagtccagcgaagtcaatcttcgcggactgtgcctcattcctacgctggtggttgagaccgccgccagaatgcggaaaacaatcgcttgttatgacctgtcttgcaaccagaccgtgtgtcaacccacagtctacctcatgggccctattcagacctgcatcacgacaaagtcctgtctgcttagcctgggcgatcagcgcatccaggtgaattatgaaaagacctactgcgtttctgggcaactcgtggagggaatttgttttaaccccatccacacaatggccctgtcccagcctagccatacctatgacattatgaccatgatggtcagatgcttccttgtgatcaaaaaggtgacatctggcgattccatgaaaattgagaagaattttgaaacgctggtccagaaaaacgggtgcaccgctaataacttccaaggatactatatctgtctcattggcagctcctctgagccgctgtacgttcccgccctggacgattaccggagcgcggaagtgctctcccgcatggcctttgctcctcacggggaggaccatgatatcgaaaagaatgccgtgagcgctatgagaatcgccggaaaggtcacaggcaaagcgccctctaccgagtccagcgacacagtgcagggcattgccttctctgggagccctctgtatacctccacgggagttcttacatctaaggatgaccccgtgtacatctgggctccgggcattatcatggaggggaaccacagcatttgcgagaaaaagaccctgcctctcacctggacaggatttatctccctgcccggcgaaatcgagaaaaccacacagtgtacggtcttctgcacccttgccgggcctggagctgattgtgaagcctatagcgaaacaggcatttttaatatctcttcccctacctgcagcattaaccgggtgcagcgcttcagaggctctgagcaacagatcaagtttgtttgtcagcgggtggacatggacattacagtctactgcaacgggatgaaaaaggtgatcctgaccaagacgctcgtcatcggacagtgtatttataccttcacatccatcttcagcctgattcccggcgtggcccactccctggctgttgagctctgcgtgcccgggctgcatggatgggcgaccatgcttctgctcctgacactgtgttttggctgggtccttatcccgaccattacgatgatcctcctgaaaattctgatcgccttcgcttacctctgctctaagtataatacagatagcaaatttcgcatcctgattgaaaaggtgaaaagagagtaccaaaagaccatggggtccatggtttgcgaagtgtgtcagtacgagtgcgaaacagccaaggagcttgagtctcaccggaaaagctgttccatcggcagctgcccctattgtctgaacccttctgaagccaccacctccgctctccaggcccatttcaaggtctgcaaactgacaagccgctttcaggagaatctgagaaagtctcttacggtgtacgaacccatgcaaggatgttatcggaccctctccctgttcagataccgcagccggtttttcgtgggcctggtttggtgcgtcctcctggtgcttgagctgattgtgtgggcggcttctgccgagacacagaacctcaatgccgggtggaccgacacagctcacggaagcggcatcattcctatgaaaaccgatctggaactggacttttcccttcccagctctgcctcctatacgtacagacgccagctccagaacccggctaatgagcaagaaaagatccctttccatctgcagctgagcaagcaggtcatccacgccgagattcaacacctcgggcattggatggatgcgacatttaacctgaaaaccgccttccactgttatggatcctgcgaaaagtacgcttacccctggcagaccgccggctgttttatcgagaaagactatgagtacgaaacagggtggggctgcaatcctcccgattgccctggagtgggcaccgggtgtacagcttgcggagtttatcttgacaagctgaaatctgtgggcaaggtcttcaagattgtgagcctccggtacacgagaaaagtttgtatccagctggggaccgagcagacatgcaagaccgtggattccaacgactgtctgattacaacctctgtcaaagtgtgccttatcggaacgatcagcaagttccaaccctccgataccctcctgtttctgggcccgctccagcagggaggcctgattttcaaacagtggtgtacaaccacatgccaatttggagaccctggcgacatcatgtctacccccacagggatgaagtgtcccgaacttaatgggagcttccgcaaaaagtgcgcctttgcgaccacgcctgtttgtcagttcgatggcaacacaatttccgggtataagcggatgatcgccaccaaagacagctttcagtctttcaatgtgaccgagccgcatatttccacaagcgctctggaatggatcgatcccgactcttccctcagagatcacatcaacgtcattgtgagccgcgacctgtcttttcaggatctgtccgagaccccttgccaaatcgaccttgccacggctagcattgatggagcctggggctccggggtgggcttcaatctggtctgcacagttagcctcaccgagtgttctgcctttctgacaagcatcaaggcttgcgacgcggccatgtgttacggatccaccacagctaacctcgtgcggggccagaacaccattcacatcgtggggaaaggaggccattctgggagcaagttcatgtgctgtcacgatacgaaatgctcctctaccggactggtcgccgccgctccccatcttgacagagtgacaggctataatcaggccgatagcgacaagatttttgacgatggcgcgcctgaatgtgggatgtcctgctggttcaagaaatctggagagtggatcctgggcgttctcaacgggaattggatggtggtcgctgtgctggttgtgctgcttatcctgagcattctcctgttcaccctctgttgcccccgccggccttcctacagaaaggaacacaaaccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16837 - RNA, 1684 nt, synthetic construct
  misc_feature 1..1684: note = mRNA product Design2 comprising derived and/or modified sequence from PUUV(K27)__L08804.1__N (opt11)
  source 1..1684: mol_type = other RNA
ggggcgctgcctacggaggtggcagccatctccttctcggcatcaagcttaccatgtccgacctcaccgacatccaagaagaaatcacccgccacgaacagcaactggtagtcgcccgacaaaagctcaaagacgccgaacgcgccgtcgaagtataccccgacgacgtcatcaaaaatacactacaagccagacagcaaacagtcagcgccctcgaagacaaactagccgactacaaaagacgcatggccgacgcagtctcacgcaagaaaatggacaccaaacccacagacccaaccggaatagaacccgacgaccacctaaaagaacgatcctccctccgctacggtaacgtactcgacgtcaacgccatcgacatcgaagaaccatccggccaaactgccgactggtacacaatcggcgtctacgtcataggcttcaccatccccatcatcctaaaagccctatacatgctctcaacccggggccggcaaacagtcaaagaaaacaaaggcacccggatccgcttcaaagacgacacctccttcgaagacattaatggcatccgccgcccaaaacacttatacgtatccatgccaaccgcacaatcaacaatgaaagcagaagaactcaccccaggacgcttccgcaccatcgtctgcggcctcttccccacacaaatccaagtccgcaacatcatgtcccccgtcatgggagtcatcggattctccttcttcgtcaaagactggcccgaaaagatacgcgagttcatggaaaaagaatgccccttcatcaaacccgaagtcaaacccggcacccccgcccaagaagtcgagttcctcaaacgcaaccgcgtctacttcatgacccgacaagacgtcctcgacaaaaaccacgtagccgacatcgacaaactgatcgactacgctgcctctggcgaccccacctcacccgacgacataaaaagccccaacgcaccatgggtcttcgcatgcgccccagaccgatccccacccacttgcatatacgtagccggcatggccgaactcggcgccttcttcagcatcctccaagacatgcgtaacacaataatggcctccaagaccgtcggcaccgccgaagaaaagctaaaacgtaaatcatcgttctaccaatcctacctaagacgcacacaatccatgggcatacaactagaccaacgcatcatcctcctatacatgctcgaatggggaaaagaaatggtcgaccatttccacctaggcgacgacatggatcccgaactgcgcggactcgcccaaagcctcatcgaccagaaagtcaaagaaatctccaaccaagaacccctaaaaatctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16838 - RNA, 3829 nt, synthetic construct
  misc_feature 1..3829: note = mRNA product Design2 comprising derived and/or modified sequence from PUUV(K27)__L08754.1__GP (opt11)
  source 1..3829: mol_type = other RNA
ggggcgctgcctacggaggtggcagccatctccttctcggcatcaagcttaccatgggtgagctctcaccggtctgcctatatctcctcctccagggcctgctgctttgcaacaccggagccgcccgcaatctaaacgaactcaaaatggaatgcccccacacaatccgactcggacaaggcctagtcgtcggatccgtagaactacccagcctccccatccaacaagtcgagacactcaaactcgaatccagttgcaatttcgacctccataccagcaccgccggccagcaatccttcacaaaatggacctgggaaataaaaggcgacctcgcggagaacacacaagcctctagcacatctttccaaaccaaaagcagcgaagttaacctccgaggcctgtgccttatccccaccctcgttgtcgaaaccgcagcacgcatgcgcaaaaccatagcatgctacgacctcagctgcaaccaaacagtctgccaaccaacagtctacctaatgggccctattcaaacatgcatcacaaccaaaagctgcctcctcagcctcggcgaccaaagaatacaagtaaactacgagaaaacgtactgcgtatctggtcagctcgtcgaaggcatctgcttcaaccccatacacacaatggcactttcacaaccctcacacacttacgacatcatgaccatgatggtccgatgcttcctggtgatcaagaaagttacctcaggtgacagcatgaaaatagagaaaaacttcgaaacactcgtccagaaaaacggctgcaccgccaacaacttccaaggatactatatctgcctgataggatcatcatcagaaccgctgtacgtcccggccctagacgactaccgatctgccgaagttctttctcgcatggccttcgcaccacacggcgaagatcacgacatagagaaaaacgcagtcagcgcaatgaggatcgcaggcaaagtaacgggcaaagctcccagcacagaaagctctgataccgtacaggggatcgcattcagcggcagcccactttacacctccactggcgtattaacaagcaaggacgaccccgtgtacatctgggccccaggcattatcatggaaggtaaccactccatatgtgaaaagaaaaccttgccgctcacttggaccggatttatctctctccccggcgaaatcgagaaaacgacccaatgcacagtcttttgtaccctagcaggaccaggcgccgactgcgaagcatacagcgaaaccggcatcttcaacattagcagccctacttgctccatcaaccgcgttcaacggttccgaggctcggaacagcaaataaaattcgtctgccaacgcgtagacatggacataaccgtctactgcaacgggatgaagaaagtcattcttaccaaaaccctagtgatagggcaatgtatatataccttcacatctatcttctcactcatcccaggagttgcacattccctcgccgtcgaactctgtgtacccggcctacatggctgggccaccatgctcctactactcaccctatgcttcggctgggtcctaatacccaccataaccatgatccttctaaaaatactcatagctttcgcctacctatgctccaaatacaacaccgactcaaaattccgaatcctcatagaaaaagtcaaacgagagtaccagaaaaccatgggatccatggtctgtgaggtatgccaatatgaatgtgagaccgcaaaagaacttgagtcccatcgcaaatcatgctcaatcggctcatgcccctactgcctgaacccatcggaggcaaccacaagtgccctccaggcacacttcaaagtatgcaagctcacttcacgcttccaagaaaatctgcgcaaaagcctaacagtctacgaacccatgcagggctgctaccgaacactatccctcttccgataccgctcgcgtttcttcgtaggcctcgtctggtgcgtcctcctcgtgctagagctaatagtatgggccgcatcagccgaaacccaaaatcttaacgccggctggacagacactgcgcacgggtccggcatcataccgatgaagaccgaccttgaacttgatttcagcctgccgagctctgcctcatacacttaccgacgccaattacaaaaccccgcaaacgagcaggagaaaatcccattccacctccaattatccaaacaagtcatacacgccgaaatacaacacctgggccactggatggacgcgacctttaacctcaaaacggctttccactgctacggaagctgcgaaaagtacgcatacccgtggcaaaccgccgggtgcttcatcgagaaagactacgaatacgaaacaggttggggctgtaacccgcccgactgccccggcgtagggacaggctgcaccgcctgcggagtatacctggacaaactcaaatctgtcggaaaagtattcaaaatcgtaagccttagatacacgcgcaaagtttgcatccaactcggtacagaacaaacatgcaaaacagtcgattctaatgactgccttatcaccacctcagtaaaagtatgtctcatcggcaccatttcaaagttccagccctccgataccctacttttcttaggcccgctacaacaaggagggctaatctttaaacaatggtgtaccacaacttgccaattcggggaccctggtgatatcatgtctactccaaccggaatgaaatgcccagaactaaacggatcattccgcaagaaatgcgcatttgctaccacgcccgtatgccaattcgacgggaacaccatatccggctacaaacgcatgatcgcaacaaaagactcattccagtccttcaacgtaacggaaccccacatcagcacaagtgccctcgaatggatagaccccgactctagtctcagagaccacatcaacgtcatagtctcacgagatctatcattccaggatctctcggaaacgccatgccagatagacctagctacggccagtatagacggagcatggggctctggcgttggattcaacctagtctgcaccgtatctctgacagaatgctccgcattcctgacttccatcaaagcatgcgacgctgccatgtgctatggctccaccaccgcaaacctagtccggggtcagaataccatacacatcgtcggaaaaggaggtcactccggatctaaattcatgtgttgccacgatacgaaatgctcgtccacagggctagtggcagcagcaccccacttggaccgagtcaccggctacaaccaggccgactccgacaaaatattcgacgacggcgcccccgaatgcgggatgagctgctggtttaagaagtccggcgaatggattcttggcgtcctgaacggaaactggatggtagttgcagtcttagtcgtcctcctcatactctcaatactactcttcaccctttgctgtccccgccgaccatcgtaccgaaaagagcataagccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16839 - RNA, 3814 nt, synthetic construct
  misc_feature 1..3814: note = mRNA product Design2 comprising derived and/or modified sequence from PUUV(K27)__L08754.1__IgE-leader_Gn-Gc (opt11)
  source 1..3814: mol_type = other RNA
ggggcgctgcctacggaggtggcagccatctccttctcggcatcaagcttaccatggattggacgtggatactctttctcgtggccgcggccacgcgcgtgcactcggcccgcaatctaaacgaactcaaaatggaatgcccccacacaatccgactcggacaaggcctagtcgtcggatccgtagaactacccagcctccccatccaacaagtcgagacactcaaactcgaatccagttgcaatttcgacctccataccagcaccgccggccagcaatccttcacaaaatggacctgggaaataaaaggcgacctcgcggagaacacacaagcctctagcacatctttccaaaccaaaagcagcgaagttaacctccgaggcctgtgccttatccccaccctcgttgtcgaaaccgcagcacgcatgcgcaaaaccatagcatgctacgacctcagctgcaaccaaacagtctgccaaccaacagtctacctaatgggccctattcaaacatgcatcacaaccaaaagctgcctcctcagcctcggcgaccaaagaatacaagtaaactacgagaaaacgtactgcgtatctggtcagctcgtcgaaggcatctgcttcaaccccatacacacaatggcactttcacaaccctcacacacttacgacatcatgaccatgatggtccgatgcttcctggtgatcaagaaagttacctcaggtgacagcatgaaaatagagaaaaacttcgaaacactcgtccagaaaaacggctgcaccgccaacaacttccaaggatactatatctgcctgataggatcatcatcagaaccgctgtacgtcccggccctagacgactaccgatctgccgaagttctttctcgcatggccttcgcaccacacggcgaagatcacgacatagagaaaaacgcagtcagcgcaatgaggatcgcaggcaaagtaacgggcaaagctcccagcacagaaagctctgataccgtacaggggatcgcattcagcggcagcccactttacacctccactggcgtattaacaagcaaggacgaccccgtgtacatctgggccccaggcattatcatggaaggtaaccactccatatgtgaaaagaaaaccttgccgctcacttggaccggatttatctctctccccggcgaaatcgagaaaacgacccaatgcacagtcttttgtaccctagcaggaccaggcgccgactgcgaagcatacagcgaaaccggcatcttcaacattagcagccctacttgctccatcaaccgcgttcaacggttccgaggctcggaacagcaaataaaattcgtctgccaacgcgtagacatggacataaccgtctactgcaacgggatgaagaaagtcattcttaccaaaaccctagtgatagggcaatgtatatataccttcacatctatcttctcactcatcccaggagttgcacattccctcgccgtcgaactctgtgtacccggcctacatggctgggccaccatgctcctactactcaccctatgcttcggctgggtcctaatacccaccataaccatgatccttctaaaaatactcatagctttcgcctacctatgctccaaatacaacaccgactcaaaattccgaatcctcatagaaaaagtcaaacgagagtaccagaaaaccatgggatccatggtctgtgaggtatgccaatatgaatgtgagaccgcaaaagaacttgagtcccatcgcaaatcatgctcaatcggctcatgcccctactgcctgaacccatcggaggcaaccacaagtgccctccaggcacacttcaaagtatgcaagctcacttcacgcttccaagaaaatctgcgcaaaagcctaacagtctacgaacccatgcagggctgctaccgaacactatccctcttccgataccgctcgcgtttcttcgtaggcctcgtctggtgcgtcctcctcgtgctagagctaatagtatgggccgcatcagccgaaacccaaaatcttaacgccggctggacagacactgcgcacgggtccggcatcataccgatgaagaccgaccttgaacttgatttcagcctgccgagctctgcctcatacacttaccgacgccaattacaaaaccccgcaaacgagcaggagaaaatcccattccacctccaattatccaaacaagtcatacacgccgaaatacaacacctgggccactggatggacgcgacctttaacctcaaaacggctttccactgctacggaagctgcgaaaagtacgcatacccgtggcaaaccgccgggtgcttcatcgagaaagactacgaatacgaaacaggttggggctgtaacccgcccgactgccccggcgtagggacaggctgcaccgcctgcggagtatacctggacaaactcaaatctgtcggaaaagtattcaaaatcgtaagccttagatacacgcgcaaagtttgcatccaactcggtacagaacaaacatgcaaaacagtcgattctaatgactgccttatcaccacctcagtaaaagtatgtctcatcggcaccatttcaaagttccagccctccgataccctacttttcttaggcccgctacaacaaggagggctaatctttaaacaatggtgtaccacaacttgccaattcggggaccctggtgatatcatgtctactccaaccggaatgaaatgcccagaactaaacggatcattccgcaagaaatgcgcatttgctaccacgcccgtatgccaattcgacgggaacaccatatccggctacaaacgcatgatcgcaacaaaagactcattccagtccttcaacgtaacggaaccccacatcagcacaagtgccctcgaatggatagaccccgactctagtctcagagaccacatcaacgtcatagtctcacgagatctatcattccaggatctctcggaaacgccatgccagatagacctagctacggccagtatagacggagcatggggctctggcgttggattcaacctagtctgcaccgtatctctgacagaatgctccgcattcctgacttccatcaaagcatgcgacgctgccatgtgctatggctccaccaccgcaaacctagtccggggtcagaataccatacacatcgtcggaaaaggaggtcactccggatctaaattcatgtgttgccacgatacgaaatgctcgtccacagggctagtggcagcagcaccccacttggaccgagtcaccggctacaaccaggccgactccgacaaaatattcgacgacggcgcccccgaatgcgggatgagctgctggtttaagaagtccggcgaatggattcttggcgtcctgaacggaaactggatggtagttgcagtcttagtcgtcctcctcatactctcaatactactcttcaccctttgctgtccccgccgaccatcgtaccgaaaagagcataagccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16840 - protein, 482 aa, synthetic construct; identical to SEQ ID NO: 588
  REGION 1..482: note = derived and/or modified protein sequence (wt) from CCHFV(10200)__NC_005302.1/U88410.1__N

SEQ ID NO: 16841 - protein, 482 aa, synthetic construct; identical to SEQ ID NO: 589
  REGION 1..482: note = derived and/or modified protein sequence (wt) from CCHFV(Turkey-Kelkit06)__GQ337053.1__N

SEQ ID NO: 16842 - protein, 1684 aa, synthetic construct; identical to SEQ ID NO: 1171
  REGION 1..1684: note = derived and/or modified protein sequence (wt) from CCHFV(10200)__U39455.2__GP

SEQ ID NO: 16843 - protein, 1684 aa, synthetic construct; identical to SEQ ID NO: 1172
  REGION 1..1684: note = derived and/or modified protein sequence (wt) from CCHFV(IbAr10200)__AF467768.2__GP

SEQ ID NO: 16844 - protein, 1688 aa, synthetic construct; identical to SEQ ID NO: 1173
  REGION 1..1688: note = derived and/or modified protein sequence (wt) from CCHFV(Turkey-Kelkit06)__GQ337054.1__GP

SEQ ID NO: 16845 - protein, 1192 aa, synthetic construct
  REGION 1..1192: note = derived and/or modified protein sequence (wt) from CCHVF(10200)__U39455.2__SP-GP_Gn-NSm-Gc
MHISLMYAILCLQLCGLGETHGSHNETSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16846 - protein, 1183 aa, synthetic construct
  REGION 1..1183: note = derived and/or modified protein sequence (wt) from CCHVF(10200)__U39455.2__IgE-leader_Gn-NSm-Gc
MDWTWILFLVAAATRVHSSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGQGKTIEAYRAREGYTSICLFVLGSILFIVSCLMKGLVDSVGNSFFPGLSICKTCSISSINGFEIESHKCYCSLFCCPYCRHCSTDKEIHKLHLSICKKRKTGSNVMLAVCKLMCFRATMEVSNRALFIRSIINTTFVLCILILAVCVVSTSAVEMENLPAGTWEREEDLTNFCHQECQVTETECLCPYEALVLRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16847 - protein, 990 aa, synthetic construct
  REGION 1..990: note = derived and/or modified protein sequence (wt) from CCHVF(10200)__U39455.2__IgE-leader_Gn-4aa-Gc
MDWTWILFLVAAATRVHSSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIGRKPLFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16848 - protein, 342 aa, synthetic construct
  REGION 1..342: note = derived and/or modified protein sequence (wt) from CCHVF(10200)__U39455.2__IgE-leader_Gn
MDWTWILFLVAAATRVHSSEEPSDDCVSRTQLLRTETAEIHGDNYGGPGDKITICNGSTIVDQRLGSELGCYTINRVRSFKLCENSATGKNCEIDSVPVKCRQGYCLRITQEGRGHVKLSRGSEVVLDACDTSCEIMIPKGTGDILVDCSGGQQHFLKDNLIDLGCPKIPLLGKMAIYICRMSNHPKTTMAFLFWFSFGYVITCILCKAIFYLLIIVGTLGRRLKQYRELKPQTCTICETTPVNAIDAEMHDLNCSYNICPYCASRLTSDGLARHVIQCPKRKEKVEETELYLNLERIPWVVRKLLQVSESTGVALKRSSWLIVLLVLFTVSLSPVQSAPIG

SEQ ID NO: 16849 - protein, 662 aa, synthetic construct
  REGION 1..662: note = derived and/or modified protein sequence (wt) from CCHVF(10200)__U39455.2__IgE-leader_Gc
MDWTWILFLVAAATRVHSFLDSTAKGMKNLLNSTSLETSLSIEAPWGAINVQSTYKPTVSTANIALSWSSVEHRGNKILVSGRSESIMKLEERTGISWDLGVEDASESKLLTVSVMDLSQMYSPVFEYLSGDRQVEEWPKATCTGDCPERCGCTSSTCLHKEWPHSRNWRCNPTWCWGVGTGCTCCGLDVKDLFTDYMFVKWKVEYIKTEAIVCVELTSQERQCSLIEAGTRFNLGPVTITLSEPRNIQQKLPPEIITLHPRIEEGFFDLMHVQKVLSASTVCKLQSCTHGVPGDLQVYHIGNLLKGDKVNGHLIHKIEPHFNTSWMSWDGCDLDYYCNMGDWPSCTYTGVTQHNHASFVNLLNIETDYTKNFHFHSKRVTAHGDTPQLDLKARPTYGAGEITVLVEVADMELHTKKIEISGLKFASLACTGCYACSSSISCKVRIHVDEPDELTVHVKSDDPDVVAASSSLMARKLEFGTDSTFKAFSAMPKTSLCFYIVEREHCKSCSEEDTKKCVNTKLEQPQSILIEHKGTIIGKQNSTCTAKASCWLESVKSFFYGLKNMLSGIFGNVFMGIFLFLAPFILLILFFMFGWRILFCFKCCRRTRGLFKYRHLKDDEETGYRRIIEKLNNKKGKNKLLDGERLADGRIAELFSTKTHIG

SEQ ID NO: 16850 - RNA, 1449 nt, synthetic construct; identical to SEQ ID NO: 2923
  misc_feature 1..1449: note = derived and/or modified CDS sequence (wt) from CCHFV(10200)__NC_005302.1/U88410.1__N
  source 1..1449: mol_type = other RNA

SEQ ID NO: 16851 - RNA, 1449 nt, synthetic construct
  misc_feature 1..1449: note = derived and/or modified CDS sequence (wt) from CCHFV(10200)__NC_005302.1/U88410.1__N
  source 1..1449: mol_type = other RNA
atggaaaacaagatcgaggtgaataacaaagatgagatgaacaggtggtttgaagagttcaaaaaaggaaatggacttgtggacaccttcacaaactcctattccttttgcgagagtgttcccaatttggacaggtttgtgtttcagatggccagtgccaccgatgatgcacagaaggactccatctacgcatctgctctggtggaggcaacaaagttttgtgcacctatatatgagtgcgcatgggttagctccactggcattgtaaaaaagggacttgaatggttcgagaaaaatgcaggaaccattaagtcctgggatgaaagttatactgagctaaaggtcgacgtcccgaaaatagagcagcttaccggttaccaacaagctgccttgaagtggagaaaagacataggtttccgtgtcaatgccaacacagcagctctgagcaacaaagtcctcgcagaatacaaagtccctggtgagattgtgatgtctgtcaaagagatgctgtcagacatgattaggagaaggaacctgattctaaacaggggtggtgatgagaacccacgtggcccagtgagccatgagcatgtagactggtgcagggagtttgtcaaaggcaaatacatcatggccttcaacccaccatggggggacatcaacaagtcaggccgttcaggaatagcacttgttgcaacaggccttgctaagctggcagagactgaaggaaagggaatatttgatgaagccaaaaagactgtggaggccctcaacgggtatctggacaagcataaggacgaagttgatagagcaagcgccgacagcatgataacaaaccttcttaagcatattgccaaggcacaggagctctataaaaattcatctgcacttcgtgcacaaagcgcacagattgacactgctttcagctcatactattggctttacaaggctggcgtgactcctgaaaccttcccgacggtgtcacagttcctctttgagctagggaaacagccaagaggtaccaagaaaatgaagaaggctctgctgagcaccccaatgaagtgggggaagaagctgtatgagctctttgccgatgattctttccagcagaacaggatttacatgcatcctgccgtgcttacagctggtagaatcagtgaaatgggagtctgctttgggacaatccctgtggccaatcctgatgatgctgcccaaggatctggacacactaagtctattctcaacctccgtaccaacactgagaccaataatccgtgtgccaaaaccatcgtcaagctatttgaagttcaaaaaacagggttcaacattcaggacatggacatagtggcctctgagcacttgctacaccaatcccttgttggcaagcaatccccattccagaacgcctacaacgtcaagggcaatgccaccagtgctaacatcatttaa

SEQ ID NO: 16852 - RNA, 1449 nt, synthetic construct; identical to SEQ ID NO: 2924
  misc_feature 1..1449: note = derived and/or modified CDS sequence (wt) from CCHFV(Turkey-Kelkit06)__GQ337053.1__N
  source 1..1449: mol_type = other RNA

SEQ ID NO: 16853 - RNA, 1449 nt, synthetic construct
  misc_feature 1..1449: note = derived and/or modified CDS sequence (wt) from CCHFV(Turkey-Kelkit06)__GQ337053.1__N
  source 1..1449: mol_type = other RNA
atggaaaacaagatcgaggtgaacagcaaggatgagatgaacaaatggtttgaggagtttaaaaagggaaatggacttatggacactttcacaaactcctactccttttgtgagaatgtaccaaatctggataagtttgtgttccagatggccagcgccacagatgatgcacagaaggactccatctatgcatcggctctagtggaagcaaccaagttctgtgcacccatatatgaatgtgcttgggtcagctctactggcattgtgaagaaggggcttgagtggttcgagaaggattcaggaactatcaaatcatgggatgagaactatgctgagctgaaggttgatgttcccaaaatagaacaacttgccaattaccaacaggctgctcttaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggctttcaatccaccttggggggacatcaacaaatcaggtcgttcgggaatagcacttgttgcaacaggccttgccaagctggcagagaccgaggggaaaggagtttttgacgaagctaagaagaccgtggaggctctcaatgggtatttggacaagcacagggacgaagtcgacaaagcaagtgctgacagcatgataacaaacctccctaagcacattgccaaagcacaagagctttataaaaattcatctgctctgcgtgcacaaggtgcacagattgacacccctttcagctcgttttactggctctacaaggccggtgtgactccagagaccttcccaaccatctcacagttcctttttgaactgggggagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatccattgttggcaagcaatctccattccaaaatgcctacaacgtcaagggcaatgccaccagtgccaacatcatctaa

SEQ ID NO: 16854 - RNA, 5055 nt, synthetic construct; identical to SEQ ID NO: 3506
  misc_feature 1..5055: note = derived and/or modified CDS sequence (wt) from CCHFV(10200)__U39455.2__GP
  source 1..5055: mol_type = other RNA

SEQ ID NO: 16855 - RNA, 5055 nt, synthetic construct
  misc_feature 1..5055: note = derived and/or modified CDS sequence (wt) from CCHFV(10200)__U39455.2__GP
  source 1..5055: mol_type = other RNA
atgcatatatcattaatgtatgcaatcctttgcctacagctgtgtggtctgggagagactcatggatcacacaatgaaactagacacaataaaacagacaccatgacaacacacggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggagatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagagttctttataactggtgagggccattttaatgaagttttacaatttagaacgccaggcacgttgagcaccacagagtcaacccctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctttagaagattgctttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16856 - RNA, 5055 nt, synthetic construct; identical to SEQ ID NO: 3507
  misc_feature 1..5055: note = derived and/or modified CDS sequence (wt) from CCHFV(IbAr10200)__AF467768.2__GP
  source 1..5055: mol_type = other RNA

SEQ ID NO: 16857 - RNA, 5055 nt, synthetic construct
  misc_feature 1..5055: note = derived and/or modified CDS sequence (wt) from CCHFV(IbAr10200)__AF467768.2__GP
  source 1..5055: mol_type = other RNA
atgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggagatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagagttctttataactggtgagggccattttaatgaagttttacaatttagaacgccaggcacgttgagcaccacagagtcaacccctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctggcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctag

SEQ ID NO: 16858 - RNA, 5067 nt, synthetic construct; identical to SEQ ID NO: 3508
  misc_feature 1..5067: note = derived and/or modified CDS sequence (wt) from CCHFV(Turkey-Kelkit06)__GQ337054.1__GP
  source 1..5067: mol_type = other RNA

SEQ ID NO: 16859 - RNA, 5067 nt, synthetic construct
  misc_feature 1..5067: note = derived and/or modified CDS sequence (wt) from CCHFV(Turkey-Kelkit06)__GQ337054.1__GP
  source 1..5067: mol_type = other RNA
atgcccaccaacattatgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagctgctgcacctcaccttagaacaggacaccgaaggcctgctagaatggtgtaagggaaaccttgggtcaaactgtgatgatgacttctttcaaaagagaatagaagagttcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagaaccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaatcccttggattgtcagaaagctattgcaggtctcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgagagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagggccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaaccagcttggaaaccagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgttgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagctgcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggagggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagctggaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaa

SEQ ID NO: 16860 - RNA, 3579 nt, synthetic construct
  misc_feature 1..3579: note = derived and/or modified CDS sequence (wt) from CCHVF(10200)__U39455.2__SP-GP_Gn-NSm-Gc
  source 1..3579: mol_type = other RNA
atgcatatatcattaatgtatgcaatcctttgcctacagctgtgtggtctgggagagactcatggatcacacaatgaaacttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16861 - RNA, 3579 nt, synthetic construct
  misc_feature 1..3579: note = derived and/or modified CDS sequence (wt) from CCHVF(10200)__U39455.2__SP-GP_Gn-NSm-Gc
  source 1..3579: mol_type = other RNA
atgcatatatcattaatgtatgcaatcctttgcctacagctgtgtggtctgggagagactcatggatcacacaatgaaacttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16862 - RNA, 3552 nt, synthetic construct
  misc_feature 1..3552: note = derived and/or modified CDS sequence (wt) from CCHVF(10200)__U39455.2__IgE-leader_Gn-NSm-Gc
  source 1..3552: mol_type = other RNA
atggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16863 - RNA, 3552 nt, synthetic construct
  misc_feature 1..3552: note = derived and/or modified CDS sequence (wt) from CCHVF(10200)__U39455.2__IgE-leader_Gn-NSm-Gc
  source 1..3552: mol_type = other RNA
atggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16864 - RNA, 2973 nt, synthetic construct
  misc_feature 1..2973: note = derived and/or modified CDS sequence (wt) from CCHVF(10200)__U39455.2__IgE-leader_Gn-4aa-Gc
  source 1..2973: mol_type = other RNA
atggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16865 - RNA, 2973 nt, synthetic construct
  misc_feature 1..2973: note = derived and/or modified CDS sequence (wt) from CCHVF(10200)__U39455.2__IgE-leader_Gn-4aa-Gc
  source 1..2973: mol_type = other RNA
atggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16866 - RNA, 1029 nt, synthetic construct
  misc_feature 1..1029: note = derived and/or modified CDS sequence (wt) from CCHVF(10200)__U39455.2__IgE-leader_Gn
  source 1..1029: mol_type = other RNA
atggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggttag

SEQ ID NO: 16867 - RNA, 1029 nt, synthetic construct
  misc_feature 1..1029: note = derived and/or modified CDS sequence (wt) from CCHVF(10200)__U39455.2__IgE-leader_Gn
  source 1..1029: mol_type = other RNA
atggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggttag

SEQ ID NO: 16868 - RNA, 1989 nt, synthetic construct
  misc_feature 1..1989: note = derived and/or modified CDS sequence (wt) from CCHVF(10200)__U39455.2__IgE-leader_Gc
  source 1..1989: mol_type = other RNA
atggactggacctggatcctgttcctcgtggccgccgcgacccgcgtccacagcttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16869 - RNA, 1989 nt, synthetic construct
  misc_feature 1..1989: note = derived and/or modified CDS sequence (wt) from CCHVF(10200)__U39455.2__IgE-leader_Gc
  source 1..1989: mol_type = other RNA
atggactggacctggatcctgttcctcgtggccgccgcgacccgcgtccacagcttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctag

SEQ ID NO: 16870 - RNA, 1449 nt, synthetic construct
  misc_feature 1..1449: note = derived and/or modified CDS sequence (opt4) from CCHFV(10200)__NC_005302.1/U88410.1__N
  source 1..1449: mol_type = other RNA
atggagaacaagatcgaggtgaacaacaaggacgagatgaacagatggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctgaccggctaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagccacgagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcatcttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagagcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgaggtgcagaagaccggcttcaacatccaggacatggacatcgtggccagcgagcatctgctgcaccagagcctggtgggcaagcagagccccttccagaacgcctacaacgtgaagggcaacgccaccagcgccaacatcatctga

SEQ ID NO: 16871 - RNA, 1449 nt, synthetic construct
  misc_feature 1..1449: note = derived and/or modified CDS sequence (opt4) from CCHFV(Turkey-Kelkit06)__GQ337053.1__N
  source 1..1449: mol_type = other RNA
atggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaaggacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgcccaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcgagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccaggagaccggcttcaacatccaggacatggacatcgtggccagcgagcatctgctgcaccagagcatcgtgggcaagcagagccccttccagaacgcctacaacgtgaagggcaacgccaccagcgccaacatcatctga

SEQ ID NO: 16872 - RNA, 5055 nt, synthetic construct
  misc_feature 1..5055: note = derived and/or modified CDS sequence (opt4) from CCHFV(10200)__U39455.2__GP
  source 1..5055: mol_type = other RNA
atgcacatcagcctgatgtacgccatcctgtgcctgcagctgtgcggcctgggcgagacccacggcagccacaacgagaccagacacaacaagaccgacaccatgaccacccacggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcttcagaagactgctgagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctga

SEQ ID NO: 16873 - RNA, 5055 nt, synthetic construct
  misc_feature 1..5055: note = derived and/or modified CDS sequence (opt4) from CCHFV(IbAr10200)__AF467768.2__GP
  source 1..5055: mol_type = other RNA
atgcacatcagcctgatgtacgccatcctgtgcctgcagctgtgcggcctgggcgagacccacggcagccacaacgagaccagacacaacaagaccgacaccatgaccacccccggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaagggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggctga

SEQ ID NO: 16874 - RNA, 5067 nt, synthetic construct
  misc_feature 1..5067: note = derived and/or modified CDS sequence (opt4) from CCHFV(Turkey-Kelkit06)__GQ337054.1__GP
  source 1..5067: mol_type = other RNA
atgcccaccaacatcatgcacacccccctggtgtgcttcatcctgtacctgcagctgctgtgcctgggcggcgcccacggccagctgaacgccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcccccccaacaccacccagggcctgagcagccccgagaccaccagcgagagacccgccaccaccagcatcagcaccagcagcaccgacagcaccaaccccaccacccagatgaccgacaacacccccacccccaccgtgagcaccagccccagcagcagccccagcacccccagcaccccccagggcatccaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagatcaccaaccacagaacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggagcaggacaccgagggcctgctggagtggtgcaagggcaacctgggcagcaactgcgacgacgacttcttccagaagagaatcgaggagttcttcatgaccggcgagtgctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagtttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgtatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtcagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgagagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagggccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggagccacagcagaaactggagatgcaaccccacctggtgctggggcgtgggcaccggctgcacctgttgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtctaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagtagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgtaccgccaaggccagctgctggctggagagcgtgaagagtttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctga

SEQ ID NO: 16875 - RNA, 3579 nt, synthetic construct
  misc_feature 1..3579: note = derived and/or modified CDS sequence (opt4) from CCHVF(10200)__U39455.2__SP-GP_Gn-NSm-Gc
  source 1..3579: mol_type = other RNA
atgcacatcagcctgatgtacgccatcctgtgcctgcagctgtgcggcctgggcgagacccacggcagccacaacgagaccagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctga

SEQ ID NO: 16876 - RNA, 3552 nt, synthetic construct
  misc_feature 1..3552: note = derived and/or modified CDS sequence (opt4) from CCHVF(10200)__U39455.2__IgE-leader_Gn-NSm-Gc
  source 1..3552: mol_type = other RNA
atggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctga

SEQ ID NO: 16877 - RNA, 2973 nt, synthetic construct
  misc_feature 1..2973: note = derived and/or modified CDS sequence (opt4) from CCHVF(10200)__U39455.2__IgE-leader_Gn-4aa-Gc
  source 1..2973: mol_type = other RNA
atggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggcagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctga

SEQ ID NO: 16878 - RNA, 1029 nt, synthetic construct
  misc_feature 1..1029: note = derived and/or modified CDS sequence (opt4) from CCHVF(10200)__U39455.2__IgE-leader_Gn
  source 1..1029: mol_type = other RNA
atggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggctga

SEQ ID NO: 16879 - RNA, 1989 nt, synthetic construct
  misc_feature 1..1989: note = derived and/or modified CDS sequence (opt4) from CCHVF(10200)__U39455.2__IgE-leader_Gc
  source 1..1989: mol_type = other RNA
atggactggacctggatcctgttcctggtggccgccgccaccagagtgcacagcttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctga

SEQ ID NO: 16880 - RNA, 1449 nt, synthetic construct; identical to SEQ ID NO: 5950
  misc_feature 1..1449: note = derived and/or modified CDS sequence (opt3) from CCHFV(10200)__NC_005302.1/U88410.1__N
  source 1..1449: mol_type = other RNA

SEQ ID NO: 16881 - RNA, 1449 nt, synthetic construct; identical to SEQ ID NO: 5951
  misc_feature 1..1449: note = derived and/or modified CDS sequence (opt3) from CCHFV(Turkey-Kelkit06)__GQ337053.1__N
  source 1..1449: mol_type = other RNA

SEQ ID NO: 16882 - RNA, 5055 nt, synthetic construct; identical to SEQ ID NO: 10252
  misc_feature 1..5055: note = derived and/or modified CDS sequence (opt3) from CCHFV(10200)__U39455.2__GP
  source 1..5055: mol_type = other RNA

SEQ ID NO: 16883 - RNA, 5055 nt, synthetic construct; identical to SEQ ID NO: 10253
  misc_feature 1..5055: note = derived and/or modified CDS sequence (opt3) from CCHFV(IbAr10200)__AF467768.2__GP
  source 1..5055: mol_type = other RNA

SEQ ID NO: 16884 - RNA, 5067 nt, synthetic construct; identical to SEQ ID NO: 10254
  misc_feature 1..5067: note = derived and/or modified CDS sequence (opt3) from CCHFV(Turkey-Kelkit06)__GQ337054.1__GP
  source 1..5067: mol_type = other RNA

SEQ ID NO: 16885 - RNA, 3579 nt, synthetic construct
  misc_feature 1..3579: note = derived and/or modified CDS sequence (opt3) from CCHVF(10200)__U39455.2__SP-GP_Gn-NSm-Gc
  source 1..3579: mol_type = other RNA
atgcacatcagcctgatgtacgccattctctgccttcagctgtgtggcttgggggagacccatggatcccacaacgaaacatctgaggaaccctcagacgattgcgtgagtagaactcaattactgaggacggagaccgctgaaatacatggtgacaattatggcgggcctggagataagatcacaatttgtaacggcagcactatcgtcgaccagcggctaggttccgagctcgggtgctacaccattaatcgcgttcgatctttcaaactgtgtgagaactcggcaacaggaaagaattgcgaaatcgattcagtgccagtaaaatgtcgtcagggctattgccttagaataacccaggagggcagggggcacgtgaagctgagccggggaagtgaagtcgtgttggacgcctgtgatacttcctgcgagatcatgattccgaaaggtacaggcgacatcctcgttgattgttctgggggacaacagcattttctgaaggacaacctgattgatctcggctgccccaagatccctttactgggtaaaatggcgatatacatttgccgcatgagcaatcacccaaagaccacgatggctttcttgttttggttctcctttgggtatgtgatcacttgtattctttgcaaagccatcttctacctgctaatcattgtcggaaccctcggcagaaggctgaagcagtatcgggagcttaaaccccagacatgtactatatgcgaaaccacacctgtgaacgcaatcgacgccgagatgcacgatctgaattgttcatacaacatttgcccatactgtgctagtcgcttgaccagcgacggcctcgcacgacatgtaatccaatgccccaagagaaaggaaaaagttgaggaaacggagctgtatttaaatctggagaggataccttgggtggtccggaagctccttcaggtgtctgaatccactggggtggccctgaaacgttcaagctggttgattgtcctactggttctctttacagtgagtctgtctccagtacagtccgctccgatcggacagggtaagaccatcgaggcctaccgcgcgagagaaggctatactagcatttgtcttttcgtgctggggtcgatcttgtttattgtctcttgcctcatgaaaggactggtggactccgttggcaactcattctttcccggtttaagtatatgtaagacatgcagcatctcctctattaatgggttcgagatcgaaagccacaaatgctactgttcactgttttgctgtccttattgcaggcattgtagtaccgataaggagatccacaagctacacctctccatttgcaaaaagcggaaaacgggcagcaacgtgatgctggcagtctgtaaacttatgtgcttccgagccaccatggaggtgtctaatcgcgctttgttcataagatcaatcattaacacaacttttgtactgtgtatcctcattctggccgtttgcgtggtcagtaccagcgcagtggaaatggagaaccttccagctggaacatgggaaagggaggaagacctgactaatttctgtcatcaagagtgccaggtcaccgagacagaatgcttgtgtccctacgaggccctcgtgctgcggaaacctttatttctggattccaccgcgaagggcatgaagaacctactcaattctacttcgctggaaacgagcctttccatcgaggccccatggggagcaataaacgttcagtcaacatataaacccaccgtgagtactgctaatatcgccttgtcttggagctccgtagagcaccgcgggaacaagattctggtctcaggtagaagcgaatctatcatgaaactcgaggaaaggaccggcatttcctgggacctgggggtggaggatgctagtgaaagcaagttactgacagtttctgtgatggacctttcccaaatgtactcaccggtcttcgagtacttgagtggagatcgtcaggtggaggaatggcctaaagcaacctgcactggcgactgtcccgagcggtgcggttgtacaagctcgacgtgcctccataaggaatggccacactcccgaaattggagatgtaaccctacctggtgctggggcgtagggactggatgtacatgctgtggcctggatgtgaaggacctatttaccgattatatgttcgttaaatggaaggtcgagtacatcaaaacagaagccatagtgtgcgtggagctgacttctcaggagaggcagtgcagcctcattgaagccgggacccgctttaatctgggacccgtcacgatcaccctttcagagccacggaacattcaacagaagttgccccctgaaatcataacactgcatccaagaatcgaggaaggtttctttgacttaatgcacgttcagaaagtgctcagtgcttccactgtgtgtaagctgcagtcttgcacccacggcgtaccgggggaccttcaagtctatcatattggaaatctgttgaagggcgataaagtgaacggtcacctcatccataagattgagccccacttcaatacaagctggatgtcctgggacgggtgtgatctggactactattgcaacatgggcgattggccttcatgtacttacaccggagttacgcagcacaatcatgcgagctttgtgaacctactgaacatcgagacagactataccaaaaatttccactttcatagtaagagggtcactgcacacggcgatacaccacagctcgacctgaaagcccgccccacctacggggctggagaaataactgtgcttgttgaggtggccgatatggaattgcataccaagaaaattgagatctctggcctgaagttcgcatccttagcctgcacaggttgttacgcttgcagctcgtcaatctcttgtaaggtacggattcacgtcgacgagcctgatgaactcacggtgcacgtgaaaagtgacgatccagacgtcgttgccgcatccagctctctgatggcgcgaaaacttgagttcgggaccgacagcacttttaaggctttctccgccatgcccaagacatcactgtgcttttatatcgtggaacgtgagcattgtaagagttgcagcgaagaggataccaagaagtgcgtaaacacaaaactagagcagccgcaatctattctcatagaacacaagggaactatcattggcaaacagaatagcacctgtacggcaaaggcctcatgctggctggagagtgtgaaatccttcttttacggtttgaagaacatgctgtccggcatcttcgggaatgtctttatgggaattttcttatttctcgctcctttcatcctgcttatactgtttttcatgtttggctggagaatcttgttctgtttcaagtgctgtaggcgcacacgggggctctttaaatatagacatctgaaggacgatgaagagaccggatacaggcgaattatcgaaaaactaaacaataagaaaggcaagaacaagctgcttgacggtgagcgcctcgccgatgggcggattgcagagctgttctctactaaaacccacatcggatga

SEQ ID NO: 16886 - RNA, 3552 nt, synthetic construct
  misc_feature 1..3552: note = derived and/or modified CDS sequence (opt3) from CCHVF(10200)__U39455.2__IgE-leader_Gn-NSm-Gc
  source 1..3552: mol_type = other RNA
atggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacaccagttgcgagataatgatcccgaaaggcacaggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggccagggcaagaccatcgaggcatatagagccagggaagggtacacttccatctgtctgtttgtgctcggaagcattctgttcatcgtttcgtgccttatgaaaggtctggtggattctgtcggcaattcctttttccccgggttgtcaatttgtaagacatgcagtataagctccatcaacggatttgagattgaatctcacaaatgttattgcagcctcttctgctgtccttactgccggcattgttcaaccgacaaggagatccacaagctgcatttaagtatctgcaaaaagcgaaaaacgggctccaatgtgatgctggctgtatgtaagctaatgtgcttccgcgccaccatggaagttagcaacagagcactctttattaggtctataatcaatacaactttcgtgctgtgtattcttatcttggctgtctgcgtggtctcaaccagtgccgtggagatggagaacctgccagcgggtacatgggaacgggaggaagatctcactaacttttgtcaccaggagtgccaagttaccgaaacagagtgtctgtgcccctatgaggcccttgtgctgcgcaaacctttgttcctcgacagcaccgcaaaggggatgaagaatctgttaaactccacttctctggaaacgtcgctaagcattgaggctccatggggcgccatcaatgtacagtccacatacaaacccaccgtctcaactgctaacatagccctcagttggtctagcgtggaacacagaggaaataagatcctggtttccggcaggtcagagagcattatgaaacttgaggaacgtaccgggatctcttgggatttgggagtggaggacgcatccgaaagtaagctgctcacagtcagcgtgatggatctgtctcagatgtattccccggtatttgagtacttatcaggtgaccggcaagtggaagagtggcctaaagccacttgcactggcgattgtcccgagcgatgcgggtgtacaagtagcacgtgcctgcataaggaatggccacactcgagaaactggaggtgtaatcctacctggtgctggggagttggcactggttgtacatgctgtgggcttgacgtcaaggatttgttcaccgactacatgtttgtgaaatggaaggtggagtatattaaaacagaagctatcgtctgcgttgagctcacttcccaggaacgccagtgttctctgatagaggcgggcacccggttcaacctaggacccgtgacgattaccctgagcgagccaagaaatatccagcaaaagctgccccctgaaattatcacactccatccaaggatagaggaaggctttttcgaccttatgcacgtgcagaaagtattgtcagcaagtactgtctgcaagctgcagtcctgcacccatggggtgccgggagatttacaggtttaccacatcggtaacctcctgaagggcgacaaagtgaatgggcaccttattcataagatcgagccccactttaacacatcttggatgagctgggatggatgtgacctggattattactgcaatatgggcgactggccttcctgtacttataccggtgtcacgcaacataaccacgcctcattcgtgaatttgctcaacattgaaacagattacaccaaaaactttcacttccatagcaagcgcgttactgctcacggggacacaccacagctggatctaaaagcccgacccacctatggcgcaggagagatcactgtgctggtagaggtcgccgacatggaactccataccaagaaaatagagattagtggcctgaagttcgcttctcttgcctgcacagggtgttacgcatgctccagctcgatctcatgtaaggtgcggatccacgtggatgaacctgacgagttgacggtccatgttaaatctgatgacccagacgtggtagcggctagttccagcctgatggcccgtaagttagagtttggaaccgattctactttcaaagcatttagcgccatgcccaagacatccctctgcttctacattgtggaaagagagcactgtaaatcatgcagtgaagaggacaccaagaagtgtgtcaatacaaaactggaacagccgcagagcatccttattgagcacaagggcactataatcggtaaacaaaactctacctgcacggctaaggcctcctgctggctggagtcagtgaaaagtttcttttatgggctaaagaatatgctcagcggaatttttggcaacgttttcatgggtatctttctgttcttggcaccttttattctgttaatcctcttctttatgttcggctggaggatactgttctgttttaagtgctgtcgccggacaagagggcttttcaaatacaggcatctgaaggatgacgaagagaccggatatcgacgcatcattgaaaaattgaataacaagaaaggcaagaataagctcctggatggggagcggctagctgacggaagaatcgccgaactgttttccactaaaacccacattggctga

SEQ ID NO: 16887 - RNA, 2973 nt, synthetic construct
  misc_feature 1..2973: note = derived and/or modified CDS sequence (opt3) from CCHVF(10200)__U39455.2__IgE-leader_Gn-4aa-Gc
  source 1..2973: mol_type = other RNA
atggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacacaagttgcgagataatgatcccgaaaggcacaggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggcagaaagcccctgtttctcgattccaccgcaaaaggcatgaagaatctgcttaacagcacttcgctggagacatctttgtccatcgaagccccttggggagctatcaatgtgcagtcaacctataaaccaacggttagtaccgccaacattgcactcagctggtcctctgtggagcacagggggaataagatcctggtcagcggtcggtcagaaagtattatgaagttagaggaacgaacaggcatatcctgggacctgggggtggaggatgctagcgagtctaaactactcactgtatcagttatggacctgagtcagatgtacagccccgtgttcgaatatctttccggagatcgccaagtcgaggaatggcctaaggccacctgtacaggcgactgcccagagagatgtggttgcacttcttcgacctgtttgcataaagaatggccccacagcaggaactggcggtgcaacccgacatggtgctggggcgtggggaccggatgtacttgctgtggcctggatgtcaaggacctctttacggattacatgttcgtgaaatggaaggttgagtatatcaagacagaggcgattgtgtgcgtagaactgacctcccaggagcgccagtgttcacttatcgaagccgggactagatttaatctgggacctgtcaccatcacattgagtgagcccaggaacattcaacagaaactcccacctgagataatcaccctgcatccccgtattgaagagggtttcttcgacttaatgcacgtgcagaaggttctgtctgcaagcactgtgtgcaaactacagtcctgtacacacggcgtcccaggggatctccaagtgtaccatatcggaaatctgcttaagggcgacaaagtaaacggtcacttgattcataagatcgaaccccactttaatacgtcatggatgagctgggacgggtgcgatctggactattactgtaacatgggcgattggccttcttgcacctacactggagtgacacagcataatcacgcttccttcgttaacctcctgaatatagagaccgactatacaaagaactttcacttccatagtaaacgggtcactgcccacggcgataccccacagttagacctgaaggctcgaccgacgtacggggccggagaaatcaccgtgcttgtggaggtcgcagatatggagttgcatactaaaaagattgaaatcagcggtctcaaatttgcctctctggcttgtactggctgctatgcgtgctcctcaagtattagctgtaaggttagaatccacgtggacgagcccgatgaactaaccgtgcacgtaaagtcggacgatcctgacgtcgtggcagcctcctctagcctgatggctaggaaactcgagttcgggacagattcaacttttaaggccttcagtgcaatgccaaaaacctccctgtgcttttacatagttgaacgcgagcattgtaagtcttgcagcgaggaagacacgaaaaagtgtgtgaatacaaaacttgagcagccccaatccattttgatcgaacacaagggaaccattatcggcaagcagaactcaacttgcacagccaaagctagctgttggctggagagtgtcaagtctttcttttatggtctcaaaaatatgttatccgggatattcggcaacgtgtttatgggaatcttcctgttccttgccccttttattctgttgatcctcttctttatgttcggctggcggattctgttttgcttcaagtgttgcagaaggacccgcgggctatttaaataccgacatctgaaggacgatgaagagactggatatcggcgtatcatagagaagctcaataacaaaaagggcaaaaacaagctgcttgacggtgaaagattggcagatgggaggattgcggagctgttcagcaccaaaacacacatcggatga

SEQ ID NO: 16888 - RNA, 1029 nt, synthetic construct
  misc_feature 1..1029: note = derived and/or modified CDS sequence (opt3) from CCHVF(10200)__U39455.2__IgE-leader_Gn
  source 1..1029: mol_type = other RNA
atggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacacaagttgcgagataatgatcccgaaaggcactggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggctga

SEQ ID NO: 16889 - RNA, 1989 nt, synthetic construct
  misc_feature 1..1989: note = derived and/or modified CDS sequence (opt3) from CCHVF(10200)__U39455.2__IgE-leader_Gc
  source 1..1989: mol_type = other RNA
atggactggacctggatcctgttcctcgtggccgctgcaacaagagtccacagctttcttgattccactgccaagggcatgaaaaacctgttaaattctacgtcattggagaccagtctgagcattgaagcgccctggggagctataaacgttcagtccacatacaagcctactgtgtctaccgccaatatcgcactatcgtggtcaagcgtagagcatagggggaacaaaattctcgtgagtggtcggtccgaatctatcatgaagctggaggaacgcacaggcattagctgggaccttggggtcgaggatgcctccgagtcaaaactgttgaccgtgagtgttatggacctcagccagatgtattctccagtgttcgaatacctgtccggagatcgacaggtcgaggaatggccgaaggctacttgcacaggcgactgtcccgagcgttgcggttgtacctcaagcacgtgcctgcacaaggagtggcctcatagtagaaattggaggtgtaacccaacttggtgctggggagtggggaccggctgtacatgctgtggcctcgatgtaaaagacttatttactgattatatgttcgttaagtggaaagtggaatacatcaagaccgaggcaatagtctgcgtggaactgacatctcaggagcggcagtgttcccttatcgaagccgggacccgctttaatttgggacccgtgacgattactctgagcgagcctagaaacatccaacagaaactaccacccgagattatcacactccaccctaggatagaagagggtttctttgacctgatgcatgtccagaaggttctttcggcttctaccgtgtgcaagctgcagtcctgcactcacggcgtaccaggggatttgcaagtgtatcacattggaaatctcctgaaaggcgacaaggtcaacggtcatttaatccacaaaattgaaccgcatttcaatacatcatggatgagttgggatgggtgtgacctggactactattgcaacatgggagattggcccagctgtacctacacgggcgtgacccagcacaatcacgcctcctttgttaacctccttaatatcgagacagactacactaagaacttccattttcactctaaacgggtgaccgcgcatggcgatacacctcagctggacttgaaggcacgcccaacttatggggccggagaaatcaccgtcctagtggaggtagctgatatggagctgcacaccaaaaagattgaaataagcggtctcaagttcgcctcactggcatgcacaggctgttacgcttgcagttccagcatctcttgtaaagttcgaatccatgtggacgagcccgatgaacttactgtccacgtgaagtcagacgatcctgacgtcgtggccgcgagtagctccctgatggccagaaaattggagtttgggacggattctacattcaaggcattctcggctatgccaaaaaccagcctctgcttttatattgttgaaagggagcactgtaagtcctgctcagaggaagacactaagaaatgtgtgaacaccaagctggagcagccccaaagtatattaattgaacataaaggaacaatcatcggcaagcaaaattctacctgcactgccaaagctagctgctggctggagtccgtaaagtcattcttttacggtctaaagaacatgctcagcgggattttcggcaatgtctttatgggaatcttcctgtttcttgccccgttcattttgctgatactctttttcatgtttggctggcggatcctgttctgttttaaatgctgtcgtcgcacaagagggcttttcaagtataggcacctgaaagacgatgaggaaacgggataccggcgaattatcgagaagttgaacaataaaaagggtaagaacaaactcctggacggcgaacgcttagcagatgggagaatcgccgagctgttctctaccaagactcatattggatga

SEQ ID NO: 16890 - RNA, 1449 nt, synthetic construct; identical to SEQ ID NO: 6642
  misc_feature 1..1449: note = derived and/or modified CDS sequence (opt1) from CCHFV(10200)__NC_005302.1/U88410.1__N
  source 1..1449: mol_type = other RNA

SEQ ID NO: 16891 - RNA, 1449 nt, synthetic construct; identical to SEQ ID NO: 6643
  misc_feature 1..1449: note = derived and/or modified CDS sequence (opt1) from CCHFV(Turkey-Kelkit06)__GQ337053.1__N
  source 1..1449: mol_type = other RNA

SEQ ID NO: 16892 - RNA, 5055 nt, synthetic construct
  misc_feature 1..5055: note = derived and/or modified CDS sequence (opt1) from CCHFV(10200)__U39455.2__GP
  source 1..5055: mol_type = other RNA
atgcacatcagcctgatgtacgccatcctctgcctgcagctgtgcggcctcggggagacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgcccccaccgtgcggacctccctgccgaacagcccctccacgcccagcacgccccaggacacccaccacccggtgcgcaacctcctgtccgtcaccagccccgggcccgacgagaccagcaccccctccggcaccggcaaggagagctccgccaccagctccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgcccggcaccctctccaccaccgagagcacgccggccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacacccccgggccgaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatccccggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggttccggcgcctcctgagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtga

SEQ ID NO: 16893 - RNA, 5055 nt, synthetic construct
  misc_feature 1..5055: note = derived and/or modified CDS sequence (opt1) from CCHFV(IbAr10200)__AF467768.2__GP
  source 1..5055: mol_type = other RNA
atgcacatcagcctgatgtacgccatcctctgcctgcagctgtgcggcctcggggagacccacggctcccacaacgagacccgccacaacaagacggacaccatgaccacccccggggacaacccgagctccgagccgcccgtgagcacggccctgtccatcaccctggaccccagcaccgtcacccccacgacccccgcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccctccggcaccggcaaggagagctccgccaccagctccccgcaccccgtgagcaaccggcccccgacgccgcccgcgaccgcccaggggcccaccgagaacgactcccacaacgccaccgagcaccccgagagcctgacgcagtccgccacccccggcctcatgaccagccccacccagatcgtgcacccgcagtccgcgacccccatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcgcctgggctccgagctggggtgctacaccatcaaccgggtccgcagcttcaagctgtgcgagaactccgcgaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggccttcctcttctggttctccttcgggtacgtgatcacgtgcatcctgtgcaaggccatcttctacctgctcatcatcgtgggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgcctgaccagcgacggcctcgcccggcacgtgatccagtgccccaagcgcaaggagaaggtggaggagaccgagctgtacctgaacctcgagcggatcccgtgggtcgtgcgcaagctgctgcaggtctccgagagcacgggcgtcgccctcaagcggtccagctggctgatcgtgctgctcgtgctgttcaccgtctccctgagccccgtgcagtccgcgcccatcgggcagggcaagaccatcgaggcctaccgcgcccgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgcgaccatggaggtgtccaaccgcgccctgttcatccggagcatcatcaacaccacgttcgtcctctgcatcctgatcctggccgtgtgcgtggtctccaccagcgccgtggagatggagaacctccccgccgggacctgggagcgcgaggaggacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccctggggcgccatcaacgtgcagagcacctacaagcccaccgtgtccaccgccaacatcgcgctgagctggagctccgtcgagcaccgcgggaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacgtgcaccggcgactgccccgagcgctgcgggtgcacgagctccacgtgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccgcccgagatcatcaccctccacccccgcatcgaggaggggttcttcgacctgatgcacgtgcagaaggtcctgagcgcgtccaccgtgtgcaagctccagagctgcacgcacggcgtccccggggacctgcaggtctaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcccacggggacacgccgcagctggacctcaaggcccgccccacctacggcgcgggggagatcaccgtcctggtggaggtggccgacatggagctgcacaccaagaagatcgagatctccggcctcaagttcgccagcctggcctgcacgggctgctacgcctgctccagcgggatctcctgcaaggtccggatccacgtggacgagcccgacgagctgaccgtgcacgtcaagagcgacgaccccgacgtggtggcggcctccagctccctcatggcccgcaagctggagttcggcaccgacagcaccttcaaggccttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgcgaaggccagctgctggctggagtccgtgaagtccttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgcgggctgttcaagtaccggcacctgaaggacgacgaggagaccggctaccgccggatcatcgagaagctcaacaacaagaagggcaagaacaagctgctggacggggagcgcctcgccgaccggcgcatcgccgagctgttcagcacgaagacccacatcggctga

SEQ ID NO: 16894 - RNA, 5067 nt, synthetic construct
  misc_feature 1..5067: note = derived and/or modified CDS sequence (opt1) from CCHFV(Turkey-Kelkit06)__GQ337054.1__GP
  source 1..5067: mol_type = other RNA
atgcccaccaacatcatgcacaccccgctggtgtgcttcatcctctacctgcagctgctctgcctgggcggggcccacggccagctgaacgccacggagcacaacgggaccaacaacaccaccgcgcccggcgccagccagtcccccaagcccccgatgagcacgaccccgccccacgcccccgagtccagcaccatcaagccgaccacgcccatctccgaggccgaggggagcggcgagaccacctccccgcccaacaccacgcagggcctcagctccccggagaccaccagcgagcgccccgccaccacgtccatcagcacctccagcaccgactccaccaaccccacgacccagatgaccgacaacacccccacgccgaccgtcagcacctcccccagctccagccccagcaccccctccacgccgcaggggatccaccaccccgcgcggagcctgctgtccgtgagctcccccaagaccgtgaccacccccacgccgaccagccccggcgagatgtccagcgagacctccagccagcactccgccatgagccgcatccccaccccgcacacggccacccgggtctccaccgagatcaccaaccaccgcaccccgcggcagagcgagtccagcgcccagcagacgaccccctcccccatgaccagcccggcgcagtccatcctcctgatgagcgccgcccccaccgccgtgcaggacatccaccccagccccacgaaccgctccaagcggaacctggagaccgagatcatcctcaccctgagccaggggctgaagaagtactacggcaagatcctcaagctgctgcacctcaccctggagcaggacacggaggggctgctcgagtggtgcaagggcaacctgggctccaactgcgacgacgacttcttccagaagcgcatcgaggagttcttcatgaccggggagtgctacttcaacgaggtgctgcagttcaagaccctcagcaccctgtccccgacggagcccagccacgcccggctgcccaccgcggagcccttcaagtcctacttcgccaagggcttcctcagcatcgactccgggtacttcagcgccaagtgctacccgcgctccagcgcctccggcctgcagctgatcaacgtcacccagcaccccgcccggatcgcggagacccccggccccaagacgaccagcctcaagaccatcaactgcatcaacctgcgcgcctccgtgttcaaggagcaccgggaggtggagatcaacgtcctgctcccgcagatcgccgtgaacctgagcaactgccacgtggtcatcaactcccacgtgtgcgactacagcctggacaccgacgggcccgtgcgcctcccccggatctaccacgagggcacgttcatccccgggacctacaagatcgtcatcgacaagaagaacaagctgaacgaccgctgcaccctggtgaccaactgcgtgatcaagggccgggaggtccgcaaggggcagagcgtgctccggcagtacaagacggagatcaagatcggcaaggcctccaccggcttccgcaagctgctgagcgaggagccgggggacgactgcatctcccggacccagctcctgcgcaccgagacggccgagatccacgacgacaactacggcgggcccggcgacaagatcaccatctgcaacgggagcaccatcgtggaccagcgcctgggctccgagctcggctgctacaccatcaaccgggtcaagagcttcaagctgtgcaagaactccgcgacggggaagacctgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcacgggcgacatcctggtggactgctccgggggccagcagcacttcctgaaggacaacctcatcgacctggggtgcccgcacatccccctgctcggccggatggccatctacatctgccgcatgagcaaccacccccggaccaccatggccttcctgttctggttctccttcggctacgtcatcacgtgcatcttctgcaaggccctgttctacagcctcatcatcatcgggaccctgggcaagaagatcaagcagtaccgcgagctgaagccccagacgtgcaccatctgcgagaccgcgccggtgaacgccatcgacgccgagatgcacgacctcaactgctcctacaacatctgcccctactgcgccagccggctgacctccgacgggctggcgcgccacgtgacgcagtgccccaagcggaaggagaaggtcgaggagaccgagctctacctgaacctggagcgcatcccgtggatcgtgcggaagctcctccaggtgagcgagagcaccggcgtcgccctgaagcgctccagctggctcatcgtgctgctggtgctcctgaccgtctccctgagccccgtgcagtccgcccccgtggggcacggcaagacgatcgagatctaccagacccgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccgtactgccgccactgctccgccgaccgggagatccaccagctgcacctgagcatctgcaagaagcgcaagaccggctccaacgtcatgctcgcggtgtgcaagcggatgtgcttccgcgccacgatcgaggccagccgccgggccctgctgatccgcagcatcatcaacaccaccttcgtgatctgcatcctcaccctgacgatctgcgtcgtgtccaccagcgccgtggagatggagaacctgcccgcgggcacctgggagcgggaggaggacctcaccaacttctgccaccaggagtgccaggtcacggagaccgagtgcctgtgcccctacgaggccctggtgctccgcaagcccctgttcctggactccatcgtgaaggggatgaagaacctcctgaacagcacctccctggagaccagcctctccatcgaggccccgtggggcgccatcaacgtccagagcacgttcaagcccaccgtgtccaccgccaacatcgcgctgagctggtccagcgtggtccaccgggggaacaagatcctggtgaccggccgctccgagagcatcatgaagctcgaggagcggacgggggtgtcctgggacctgggcgtcgaggacgccagcgagtccaagctgctcaccgtgagcatcatggacctgtcccagatgtacagccccgtgttcgagtacctgagcggcgaccgccaggtcgaggagtggcccaaggcgacctgcaccggggactgcccggagcggtgcggctgcacgtccagcacgtgcctccacaaggagtggtcccacagccgcaactggcggtgcaaccccacctggtgctggggcgtgggcaccgggtgcacgtgctgcggcgtggacgtcaaggacctgttcaccgaccacatgttcgtgaagtggaaggtggagtacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaggagggcttcttcgacctgatgcacgtccagaaggtgctcagcgcctccaccgtgtgcaagctgcagagctgcacgcacgggatccccggcgacctgcaggtctaccacatcggcaacctcctgaagggggaccgggtgaacggccacctgatccacaagatcgagtcccacttcaacaccagctggatgtcctgggacgggtgcgacctcgactactactgcaacatgggcgactggccgagctgcacctacaccggggtcacgcagcacaaccacgccgccttcgtgaacctgctgaacatcgagaccgactacaccaagaccttccacttccactccaagcgcgtgacggcgcacggcgacaccccgcagctcgacctgaaggcccggcccacctacggcgccgggggcatcaccgtcctggtggaggtggccgacatggagctccacacgaagaaggtcgagatcagcgggctgaagttcgcctccctggcgtgcaccggctgctacgcctgcagctccgggatcagctgcaaggtgcgcatccacgtggacgagcccgacgagctcaccgtccacgtcaagagctccgacccggacgtggtcgccgccagcacctccctgatggcccggaagctggagttcggcacggacagcaccttcaaggcgttctccgccatgcccaagaccagcctctgcttctacatcgtggagcgcgagtactgcaagtcctgcagcgaggacgacacccagaagtgcgtggacacgcggctggagcagccccagtccatcctgatcgagcacaagggcaccatcatcgggaagcagaacgacacgtgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacgcggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctga

SEQ ID NO: 16895 - RNA, 3579 nt, synthetic construct
  misc_feature 1..3579: note = derived and/or modified CDS sequence (opt1) from CCHVF(10200)__U39455.2__SP-GP_Gn-NSm-Gc
  source 1..3579: mol_type = other RNA
atgcacatcagcctgatgtacgccatcctctgcctgcagctgtgcggcctcggggagacccacggctcccacaacgagaccagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtga

SEQ ID NO: 16896 - RNA, 3552 nt, synthetic construct
  misc_feature 1..3552: note = derived and/or modified CDS sequence (opt1) from CCHVF(10200)__U39455.2__IgE-leader_Gn-NSm-Gc
  source 1..3552: mol_type = other RNA
atggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtga

SEQ ID NO: 16897 - RNA, 2973 nt, synthetic construct
  misc_feature 1..2973: note = derived and/or modified CDS sequence (opt1) from CCHVF(10200)__U39455.2__IgE-leader_Gn-4aa-Gc
  source 1..2973: mol_type = other RNA
atggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtga

SEQ ID NO: 16898 - RNA, 1029 nt, synthetic construct
  misc_feature 1..1029: note = derived and/or modified CDS sequence (opt1) from CCHVF(10200)__U39455.2__IgE-leader_Gn
  source 1..1029: mol_type = other RNA
atggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggtga

SEQ ID NO: 16899 - RNA, 1989 nt, synthetic construct
  misc_feature 1..1989: note = derived and/or modified CDS sequence (opt1) from CCHVF(10200)__U39455.2__IgE-leader_Gc
  source 1..1989: mol_type = other RNA
atggactggacctggatcctgttcctcgtggccgccgcgacccgcgtccacagcttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtga

SEQ ID NO: 16900 - RNA, 1449 nt, synthetic construct; identical to SEQ ID NO: 6642
  misc_feature 1..1449: note = derived and/or modified CDS sequence (opt1) from CCHFV(10200)__NC_005302.1/U88410.1__N
  source 1..1449: mol_type = other RNA

SEQ ID NO: 16901 - RNA, 1449 nt, synthetic construct; identical to SEQ ID NO: 6643
  misc_feature 1..1449: note = derived and/or modified CDS sequence (opt1) from CCHFV(Turkey-Kelkit06)__GQ337053.1__N
  source 1..1449: mol_type = other RNA

SEQ ID NO: 16902 - RNA, 5055 nt, synthetic construct; identical to SEQ ID NO: 11895
  misc_feature 1..5055: note = derived and/or modified CDS sequence (opt1) from CCHFV(10200)__U39455.2__GP
  source 1..5055: mol_type = other RNA

SEQ ID NO: 16903 - RNA, 5055 nt, synthetic construct; identical to SEQ ID NO: 11896
  misc_feature 1..5055: note = derived and/or modified CDS sequence (opt1) from CCHFV(IbAr10200)__AF467768.2__GP
  source 1..5055: mol_type = other RNA

SEQ ID NO: 16904 - RNA, 5067 nt, synthetic construct; identical to SEQ ID NO: 11897
  misc_feature 1..5067: note = derived and/or modified CDS sequence (opt1) from CCHFV(Turkey-Kelkit06)__GQ337054.1__GP
  source 1..5067: mol_type = other RNA

SEQ ID NO: 16905 - RNA, 3579 nt, synthetic construct
  misc_feature 1..3579: note = derived and/or modified CDS sequence (opt1) from CCHVF(10200)__U39455.2__SP-GP_Gn-NSm-Gc
  source 1..3579: mol_type = other RNA
atgcacatcagcctgatgtacgccatcctctgcctgcagctgtgcggcctcggggagacccacggctcccacaacgagaccagcgaggagccctccgacgactgcgtgagccgcacgcagctgctgcggaccgagaccgccgagatccacggggacaactacggcgggccgggcgacaagatcaccatctgcaacggctccacgatcgtcgaccagcgcctcgggagcgagctgggctgctacaccatcaaccgggtgcgctccttcaagctgtgcgagaacagcgcgaccgggaagaactgcgagatcgactccgtgcccgtcaagtgccggcagggctactgcctccgcatcacccaggaggggcggggccacgtgaagctgagccgcggctccgaggtggtcctggacgcctgcgacacgagctgcgagatcatgatccccaaggggaccggcgacatcctcgtggactgctccgggggccagcagcacttcctgaaggacaacctgatcgacctcggctgccccaagatcccgctgctggggaagatggccatctacatctgccggatgagcaaccaccccaagaccaccatggccttcctcttctggttctccttcggctacgtgatcacgtgcatcctgtgcaaggccatcttctacctgctcatcatcgtcgggaccctgggccgccggctgaagcagtaccgcgagctcaagccccagacctgcaccatctgcgagacgacccccgtgaacgcgatcgacgccgagatgcacgacctgaactgcagctacaacatctgcccgtactgcgcctcccggctgaccagcgacgggctcgcccgccacgtgatccagtgccccaagcggaaggagaaggtcgaggagaccgagctgtacctgaacctcgagcgcatcccctgggtggtgcggaagctgctgcaggtctccgagagcacgggcgtggcgctcaagcgcagctcctggctgatcgtgctgctcgtcctgttcaccgtgagcctgtcccccgtgcagagcgccccgatcggccaggggaagaccatcgaggcctaccgggcccgcgagggctacacctccatctgcctcttcgtcctggggagcatcctgttcatcgtgtcctgcctcatgaagggcctggtggacagcgtcgggaactccttcttccccggcctgagcatctgcaagacgtgctccatcagctccatcaacggcttcgagatcgagagccacaagtgctactgctccctcttctgctgcccctactgccggcactgcagcaccgacaaggagatccacaagctgcacctgtccatctgcaagaagcgcaagaccgggagcaacgtgatgctcgccgtctgcaagctgatgtgcttccgcgcgaccatggaggtgtccaaccgggccctgttcatccgcagcatcatcaacacgaccttcgtgctgtgcatcctcatcctggccgtctgcgtggtgagcacctccgccgtcgagatggagaacctgcccgccggcacctgggagcgggaggaggacctcacgaacttctgccaccaggagtgccaggtgaccgagaccgagtgcctgtgcccgtacgaggcgctggtgctccgcaagcccctgttcctggacagcaccgccaaggggatgaagaacctcctgaactccacgagcctggagacctccctcagcatcgaggccccctggggcgccatcaacgtccagtccacctacaagcccaccgtgagcaccgccaacatcgcgctgtcctggagctccgtggagcaccgggggaacaagatcctggtcagcggccgctccgagagcatcatgaagctcgaggagcggacgggcatctcctgggacctgggggtggaggacgccagcgagtccaagctgctcaccgtgagcgtcatggacctgagccagatgtactccccggtgttcgagtacctgagcggcgaccgccaggtggaggagtggcccaaggccacctgcaccggggactgccccgagcggtgcggctgcacgtccagcacctgcctccacaaggagtggccccactcccgcaactggcggtgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacgcggttcaacctggggcccgtcaccatcaccctcagcgagccccgcaacatccagcagaagctgcccccggagatcatcaccctgcacccccggatcgaggagggcttcttcgacctcatgcacgtgcagaaggtgctgtccgcgagcacggtctgcaagctgcagtcctgcacccacggcgtgcccggggacctccaggtgtaccacatcggcaacctgctgaagggggacaaggtcaacggccacctcatccacaagatcgagccgcacttcaacaccagctggatgtcctgggacgggtgcgacctggactactactgcaacatgggcgactggcccagctgcacctacacgggcgtgacccagcacaaccacgcctccttcgtgaacctgctcaacatcgagaccgactacaccaagaacttccacttccacagcaagcgcgtcacggcccacggggacaccccccagctggacctgaaggcccggcccacctacggcgcgggggagatcaccgtgctcgtggaggtcgccgacatggagctgcacacgaagaagatcgagatctccggcctgaagttcgccagcctcgcctgcaccgggtgctacgcctgctccagcagcatctcctgcaaggtgcgcatccacgtggacgagccggacgagctgaccgtccacgtgaagagcgacgaccccgacgtggtcgcggcctccagctccctgatggcccggaagctcgagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctggagcagccccagtccatcctcatcgagcacaagggcacgatcatcgggaagcagaacagcacctgcaccgcgaaggcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcgcatcctcttctgcttcaagtgctgccggcgcacccggggcctgttcaagtaccgccacctgaaggacgacgaggagaccgggtaccggcgcatcatcgagaagctcaacaacaagaagggcaagaacaagctgctggacggggagcggctcgccgacggccgcatcgccgagctgttctccacgaagacccacatcggctga

SEQ ID NO: 16906 - RNA, 3552 nt, synthetic construct
  misc_feature 1..3552: note = derived and/or modified CDS sequence (opt1) from CCHVF(10200)__U39455.2__IgE-leader_Gn-NSm-Gc
  source 1..3552: mol_type = other RNA
atggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctgcaggtgagcgagtccacgggggtcgccctcaagcggagcagctggctgatcgtgctgctcgtgctgttcaccgtctccctgagccccgtgcagtccgccccgatcggccaggggaagaccatcgaggcctaccgcgcgcgggagggctacaccagcatctgcctcttcgtgctgggctccatcctgttcatcgtcagctgcctcatgaaggggctggtggactccgtcggcaacagcttcttccccgggctgtccatctgcaagacgtgcagcatctccagcatcaacggcttcgagatcgagtcccacaagtgctactgcagcctcttctgctgcccctactgccgccactgctccaccgacaaggagatccacaagctgcacctgagcatctgcaagaagcgcaagaccgggtccaacgtgatgctcgccgtgtgcaagctgatgtgcttccgggccaccatggaggtcagcaaccgcgccctgttcatccggtccatcatcaacacgaccttcgtgctctgcatcctgatcctggccgtgtgcgtcgtgagcaccagcgcggtggagatggagaacctgcccgccggcacctgggagcgcgaggaggacctcacgaacttctgccaccaggagtgccaggtcaccgagaccgagtgcctgtgcccgtacgaggccctggtgctccggaagcccctgttcctggactccaccgccaagggcatgaagaacctcctgaacagcacgtccctggagaccagcctctccatcgaggccccctggggggcgatcaacgtgcagagcacctacaagcccaccgtctccaccgccaacatcgccctgagctggtccagcgtggagcaccgcggcaacaagatcctggtgtccgggcggagcgagtccatcatgaagctcgaggagcgcacgggcatcagctgggacctgggggtcgaggacgcctccgagagcaagctgctcaccgtgtccgtgatggacctgagccagatgtacagcccggtcttcgagtacctgtccggcgaccggcaggtggaggagtggcccaaggccacctgcaccggcgactgccccgagcgctgcgggtgcacgagctccacctgcctccacaaggagtggccccacagccggaactggcgctgcaacccgacctggtgctggggcgtggggaccggctgcacgtgctgcggcctggacgtcaaggacctgttcaccgactacatgttcgtgaagtggaaggtggagtacatcaagaccgaggcgatcgtctgcgtggagctcacctcccaggagcggcagtgcagcctgatcgaggccgggacgcgcttcaacctgggccccgtgaccatcaccctctccgagccccggaacatccagcagaagctgcccccggagatcatcaccctgcacccccgcatcgaggaggggttcttcgacctcatgcacgtccagaaggtgctgagcgcctccacggtgtgcaagctgcagagctgcacccacggcgtccccggggacctccaggtgtaccacatcggcaacctgctgaagggcgacaaggtgaacgggcacctcatccacaagatcgagccgcacttcaacacctcctggatgagctgggacggctgcgacctggactactactgcaacatgggggactggccctcctgcacctacacgggcgtcacccagcacaaccacgccagcttcgtgaacctgctcaacatcgagaccgactacaccaagaacttccacttccactccaagcgggtgacggcgcacggggacaccccccagctggacctgaaggcccgccccacctacggcgccggcgagatcaccgtcctcgtggaggtggccgacatggagctgcacacgaagaagatcgagatcagcgggctgaagttcgcctccctcgcgtgcaccggctgctacgcctgcagctccagcatcagctgcaaggtccggatccacgtggacgagccggacgagctgaccgtgcacgtcaagtccgacgaccccgacgtggtggccgccagctccagcctgatggcccgcaagctcgagttcgggaccgactccacgttcaaggcgttcagcgccatgcccaagacctccctgtgcttctacatcgtcgagcgcgagcactgcaagagctgctccgaggaggacaccaagaagtgcgtgaacaccaagctggagcagccccagagcatcctcatcgagcacaagggcacgatcatcgggaagcagaactccacctgcaccgccaaggccagctgctggctggagtccgtgaagagcttcttctacggcctgaagaacatgctctccggcatcttcgggaacgtcttcatgggcatcttcctgttcctggccccgttcatcctcctgatcctgttcttcatgttcgggtggcggatcctcttctgcttcaagtgctgccgccggacccgcggcctgttcaagtaccggcacctgaaggacgacgaggagaccgggtaccgccggatcatcgagaagctcaacaacaagaagggcaagaacaagctgctggacggcgagcgcctcgcggacgggcggatcgccgagctgttcagcacgaagacccacatcggctga

SEQ ID NO: 16907 - RNA, 2973 nt, synthetic construct
  misc_feature 1..2973: note = derived and/or modified CDS sequence (opt1) from CCHVF(10200)__U39455.2__IgE-leader_Gn-4aa-Gc
  source 1..2973: mol_type = other RNA
atggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctgcaggtgagcgagtccacgggggtcgccctcaagcggagcagctggctgatcgtgctgctcgtgctgttcaccgtctccctgagccccgtgcagtccgccccgatcggccgcaagcccctcttcctggacagcaccgccaaggggatgaagaacctgctcaactccaccagcctggagacgtccctgagcatcgaggcgccctggggcgccatcaacgtgcagtccacctacaagcccaccgtcagcaccgccaacatcgccctctcctggagctccgtggagcaccggggcaacaagatcctggtcagcgggcgctccgagagcatcatgaagctggaggagcgcacgggcatctcctgggacctcggggtggaggacgccagcgagtccaagctgctgaccgtgagcgtcatggacctcagccagatgtactccccggtgttcgagtacctgagcggcgaccggcaggtggaggagtggcccaaggcgacctgcaccggggactgccccgagcgctgcggctgcacgtccagcacctgcctgcacaaggagtggccccactcccggaactggcgctgcaacccgacctggtgctggggcgtcgggaccggctgcacgtgctgcgggctggacgtgaaggacctcttcaccgactacatgttcgtgaagtggaaggtcgagtacatcaagaccgaggccatcgtgtgcgtggagctgaccagccaggagcggcagtgctccctgatcgaggccggcacccgcttcaacctcgggcccgtcacgatcaccctgagcgagccccggaacatccagcagaagctgcccccggagatcatcaccctccacccccgcatcgaggagggcttcttcgacctgatgcacgtgcagaaggtgctgtccgccagcaccgtctgcaagctccagtcctgcacgcacggcgtgcccggggacctgcaggtgtaccacatcggcaacctgctcaagggggacaaggtcaacggccacctgatccacaagatcgagccccacttcaacaccagctggatgtcctgggacggctgcgacctggactactactgcaacatgggggactggccgagctgcacctacaccggcgtgacgcagcacaaccacgcctccttcgtgaacctcctgaacatcgagaccgactacaccaagaacttccacttccacagcaagcgggtcaccgcgcacggggacacgccccagctggacctcaaggcccgccccacctacggcgccggggagatcaccgtgctggtggaggtcgccgacatggagctgcacaccaagaagatcgagatctccggcctcaagttcgccagcctggcgtgcacgggctgctacgcctgcagctccagcatctcctgcaaggtgcggatccacgtggacgagccggacgagctgaccgtccacgtgaagagcgacgaccccgacgtggtcgccgcctccagctccctcatggcgcgcaagctggagttcgggaccgacagcaccttcaaggccttctccgccatgcccaagacgagcctgtgcttctacatcgtggagcgggagcactgcaagtcctgcagcgaggaggacaccaagaagtgcgtgaacaccaagctcgagcagccccagtccatcctgatcgagcacaagggcaccatcatcgggaagcagaacagcacgtgcaccgccaaggcctcctgctggctggagagcgtcaagtccttcttctacggcctcaagaacatgctgagcgggatcttcggcaacgtgttcatgggcatcttcctgttcctcgcgccgttcatcctgctgatcctcttcttcatgttcgggtggcgcatcctgttctgcttcaagtgctgccggcgcacccggggcctgttcaagtaccgccacctcaaggacgacgaggagaccgggtaccggcgcatcatcgagaagctgaacaacaagaagggcaagaacaagctgctcgacggggagcgcctggccgacggccggatcgccgagctgttctccacgaagacccacatcggctga

SEQ ID NO: 16908 - RNA, 1029 nt, synthetic construct
  misc_feature 1..1029: note = derived and/or modified CDS sequence (opt1) from CCHVF(10200)__U39455.2__IgE-leader_Gn
  source 1..1029: mol_type = other RNA
atggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctccaggtgagcgagtccacgggggtcgccctgaagcggagcagctggctgatcgtgctgctcgtgctgttcaccgtctccctgagccccgtgcagtccgccccgatcggctga

SEQ ID NO: 16909 - RNA, 1989 nt, synthetic construct
  misc_feature 1..1989: note = derived and/or modified CDS sequence (opt1) from CCHVF(10200)__U39455.2__IgE-leader_Gc
  source 1..1989: mol_type = other RNA
atggactggacctggatcctgttcctcgtggccgccgcgacccgcgtccacagcttcctggactccacggccaagggcatgaagaacctgctcaacagcacctccctggagaccagcctgtccatcgaggccccctggggcgccatcaacgtgcagagcacctacaagccgacggtgtccaccgccaacatcgcgctcagctggtccagcgtcgagcaccgggggaacaagatcctggtgtccgggcgcagcgagtccatcatgaagctggaggagcggaccggcatcagctgggacctcggggtggaggacgcctccgagagcaagctgctgaccgtctccgtgatggacctcagccagatgtactcccccgtgttcgagtacctgagcggcgaccgccaggtcgaggagtggcccaaggccacgtgcaccggcgactgccccgagcggtgcgggtgcaccagctccacgtgcctgcacaaggagtggccgcacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcgccagtgcagcctcatcgaggcgggcacccggttcaacctgggccccgtgaccatcacgctgtccgagccccgcaacatccagcagaagctcccgcccgagatcatcaccctgcacccccggatcgaggaggggttcttcgacctgatgcacgtgcagaaggtcctcagcgcctccaccgtgtgcaagctgcagagctgcacccacggcgtgcccggggacctgcaggtctaccacatcggcaacctcctgaagggcgacaaggtgaacgggcacctgatccacaagatcgagccgcacttcaacacgtcctggatgagctgggacggctgcgacctcgactactactgcaacatgggggactggccctcctgcacctacaccggcgtgacccagcacaaccacgccagcttcgtcaacctgctgaacatcgagacggactacaccaagaacttccacttccactccaagcgcgtgaccgcccacggggacacgccccagctcgacctgaaggcccggcccacctacggcgcgggcgagatcaccgtcctggtggaggtggccgacatggagctccacaccaagaagatcgagatcagcgggctgaagttcgcctccctggcctgcaccggctgctacgcctgcagctccagcatctcctgcaaggtccgcatccacgtggacgagccggacgagctcacggtgcacgtcaagagcgacgaccccgacgtggtggcggccagctccagcctgatggcccggaagctggagttcgggaccgactccaccttcaaggccttcagcgccatgcccaagacctccctctgcttctacatcgtcgagcgcgagcactgcaagagctgctccgaggaggacaccaagaagtgcgtgaacacgaagctggagcagccccagagcatcctgatcgagcacaagggcaccatcatcgggaagcagaactccacgtgcaccgcgaaggccagctgctggctcgagtccgtcaagagcttcttctacggcctgaagaacatgctgtccggcatcttcgggaacgtgttcatgggcatcttcctcttcctggccccgttcatcctgctgatcctcttcttcatgttcgggtggcggatcctgttctgcttcaagtgctgccgccggacccgcggcctgttcaagtaccggcacctcaaggacgacgaggagaccgggtaccgccgcatcatcgagaagctgaacaacaagaagggcaagaacaagctgctcgacggcgagcggctggccgacgggcgcatcgccgagctgttcagcaccaagacccacatcggctga

SEQ ID NO: 16910 - RNA, 1449 nt, synthetic construct; identical to SEQ ID NO: 7334
  misc_feature 1..1449: note = derived and/or modified CDS sequence (opt5) from CCHFV(10200)__NC_005302.1/U88410.1__N
  source 1..1449: mol_type = other RNA

SEQ ID NO: 16911 - RNA, 1449 nt, synthetic construct; identical to SEQ ID NO: 7335
  misc_feature 1..1449: note = derived and/or modified CDS sequence (opt5) from CCHFV(Turkey-Kelkit06)__GQ337053.1__N
  source 1..1449: mol_type = other RNA

SEQ ID NO: 16912 - RNA, 5055 nt, synthetic construct; identical to SEQ ID NO: 13538
  misc_feature 1..5055: note = derived and/or modified CDS sequence (opt5) from CCHFV(10200)__U39455.2__GP
  source 1..5055: mol_type = other RNA

SEQ ID NO: 16913 - RNA, 5055 nt, synthetic construct; identical to SEQ ID NO: 13539
  misc_feature 1..5055: note = derived and/or modified CDS sequence (opt5) from CCHFV(IbAr10200)__AF467768.2__GP
  source 1..5055: mol_type = other RNA

SEQ ID NO: 16914 - RNA, 5067 nt, synthetic construct; identical to SEQ ID NO: 13540
  misc_feature 1..5067: note = derived and/or modified CDS sequence (opt5) from CCHFV(Turkey-Kelkit06)__GQ337054.1__GP
  source 1..5067: mol_type = other RNA

SEQ ID NO: 16915 - RNA, 3579 nt, synthetic construct
  misc_feature 1..3579: note = derived and/or modified CDS sequence (opt5) from CCHVF(10200)__U39455.2__SP-GP_Gn-NSm-Gc
  source 1..3579: mol_type = other RNA
atgcacatcagcctgatgtacgccattctctgcctgcagctttgtggcctgggggagacccatggatcccacaacgaaacatctgaggaacccagcgacgattgcgtgtccagaacgcagctcctgcggaccgagacagctgaaatccatggcgacaattatgggggacctggcgataagattaccatctgtaacgggtctacaattgtcgaccagcgccttggaagcgagctgggctgctacaccatcaatagagttcggtccttcaaactctgtgagaactctgccacaggcaagaattgcgaaatcgatagcgtgccggtgaaatgtcgccaggggtattgcctgagaattacccaggagggacggggccacgtcaagctgtcccgcgggagcgaagtggttctcgacgcgtgtgatacgtcttgcgagatcatgattcccaaaggaaccggcgacatcctggtggattgttccgggggacaacagcattttcttaaggacaacctgattgatctcggctgccctaagatccccctgcttggcaaaatggctatttacatctgcagaatgagcaatcaccctaagacaaccatggccttcctgttttggttctcttttgggtatgtcatcacatgtattctctgcaaagccatcttctacctgctgattatcgtgggaaccctcggccggcgcctgaagcagtatagagagcttaaaccccagacgtgtacaatttgcgaaaccacacctgttaacgctatcgacgccgagatgcacgatctgaattgttcctacaacatctgcccgtactgtgctagccggctcacctctgacgggctggcccgccatgtgattcaatgccccaagagaaaggaaaaagtcgaggaaaccgagctttatctgaatctcgagcggatcccttgggtggtgcgcaagctgctgcaggtctccgaaagcacaggagttgcgctcaaaagatcctcttggctgattgtgcttctggtgctctttacggtcagcctgtcccccgtgcagagcgcccctatcggccaggggaagaccattgaggcttaccgggccagagaaggatatacatctatctgtcttttcgttctgggctccatcctctttattgtgagctgcctgatgaaaggcctggtcgactctgtggggaacagcttctttcccggactctccatctgtaagacctgctctattagctccatcaatggcttcgagattgaaagccacaaatgctactgttctctgttttgctgtccgtattgccgccattgttccacagataaggagatccacaagctccacctgagcatttgcaaaaagcggaaaaccgggtctaacgttatgctcgctgtgtgtaagctgatgtgcttcagagccacgatggaggtctccaatcgcgcgctgttcatccggagcatcattaacacaacctttgtgctttgtatcctcattctggccgtctgcgtggtttccacctctgctgtggaaatggagaacctgcctgccggaacatgggaaagagaggaagacctcaccaatttctgtcatcaagagtgccaggtcacagagacggaatgcctgtgtccctacgaggctcttgtgctgcgcaaacctctctttctggatagcaccgccaagggcatgaagaacctgcttaattccacatctctcgaaaccagcctgtccatcgaggccccctggggcgctattaacgttcagagcacatataaacccaccgtgtctacggcgaatatcgccctgtcctggagctctgtcgagcaccgggggaacaagatcctcgtgtccggaagaagcgaatctattatgaaactggaggaacgcaccggcatcagctgggaccttggggtggaggatgcttccgaaagcaagctgctcacagtttctgtcatggacctgtcccaaatgtacagccctgtgttcgagtacctgtccggagatagacaggtggaggaatggccgaaagctacctgcacaggcgactgtcccgagcggtgcgggtgtacctctagcacgtgccttcataaggaatggcctcactcccgcaattggcggtgtaaccccacatggtgctggggagtcggcaccgggtgtacatgctgtggcctcgatgtgaaggacctgtttaccgattatatgttcgttaaatggaaggtggagtacattaaaaccgaagccatcgtctgcgtggagctgacatctcaggagagacagtgcagcctcattgaagccggaacgcggtttaatctgggccctgttaccatcacactttccgagccccgcaacatccaacagaagctgccgcctgaaattatcaccctccatcccagaattgaggaagggttctttgacctgatgcacgtgcagaaagtcctgtctgccagcacagtgtgtaaacttcagtcctgcacccacggagttcctggcgacctccaagtgtatcatatcgggaatctgctgaagggagataaagtcaacggccacctcattcataagatcgagccccacttcaatacgagctggatgtcttgggacgggtgtgatctggactactattgcaacatgggcgattggccttcctgtacatacaccggagtgacccagcacaatcatgcgagctttgtgaaccttctgaacatcgagacagactataccaaaaatttccactttcattctaagcgggtcacagctcacggcgatacgccccagctcgacctgaaagccagaccgacctacggggccggagaaattacagttctggtggaggtggctgatatggaacttcataccaagaaaatcgagatttccggcctgaagttcgccagcctcgcttgcacagggtgttacgcctgttcttccagcatctcctgcaaggtccgcattcacgtggacgagcctgatgaactgaccgttcacgtgaaaagcgacgatcccgacgtcgtggcggcctctagctccctcatggctcggaagctggagttcggaacggactctacctttaaagccttcagcgctatgcccaagacatccctttgcttttatatcgttgaaagagagcattgtaaatcttgcagcgaagaggataccaagaagtgcgtgaacacaaaactggagcagcctcaatccattctcatcgaacacaagggcaccatcattgggaaacaaaattctacatgtaccgccaaggcgagctgctggctggagtccgtcaagagcttcttttacggcctgaagaacatgctttctggaatcttcggcaatgtgtttatggggattttcctgtttctcgccccgttcatcctgctcattctgtttttcatgtttggatggcgcatccttttctgtttcaagtgctgtagacggacgcgcggcctgtttaaatatagacatctcaaggacgatgaagagacagggtaccggcgcatcattgaaaaactgaacaataagaaaggaaagaacaagctgcttgacggcgagagactggctgatggccggatcgccgagcttttctccaccaaaacccacattgggtga

SEQ ID NO: 16916 - RNA, 3552 nt, synthetic construct
  misc_feature 1..3552: note = derived and/or modified CDS sequence (opt5) from CCHVF(10200)__U39455.2__IgE-leader_Gn-NSm-Gc
  source 1..3552: mol_type = other RNA
atggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaagctgctgcaagtgtctgagtccacaggagtggctctcaaacggagctcctggctgatcgtcctgctcgtgctgttcacggtttctcttagccccgtgcagtccgcccctattggccaggggaagaccatcgaggcttatagagcccgcgaaggatacacaagcatttgtctgtttgtcctcggctctatcctgttcatcgtgtcctgccttatgaaagggctggttgatagcgtgggaaattctttctttcccggcctcagcatttgtaagacctgctccatctctagcattaacggctttgagatcgaatcccacaaatgttattgcagcctgttctgctgtccgtactgccggcattgttctacagacaaggagattcacaagctgcatctctccatctgcaaaaagagaaaaaccgggagcaatgtcatgctggcggtgtgtaaacttatgtgcttccgcgccacgatggaagtctctaaccgggctctgtttattagatccatcatcaatacaaccttcgtgctctgtattctgatcctggccgtttgcgtggtcagcacctccgctgtggagatggagaaccttcctgccggaacatgggaacgcgaggaagatctcaccaacttttgtcaccaggagtgccaagttacagaaacggagtgtctgtgcccctatgaggccctggtgctccggaagcctctgttccttgactctaccgctaagggcatgaagaatctgctcaacagcacatccctggaaacctctctgagcattgaggcgccctggggagccatcaatgtccagtccacatacaaacccaccgtgagcacggctaacattgccctttcttggtccagcgtggaacacagagggaataagatcctcgtttctggccgctccgagagcatcatgaaactggaggaacggaccgggatttcttgggatctgggcgtcgaggacgccagcgaatccaagctcctgacagtgagcgtgatggatctttctcagatgtattcccctgtctttgagtacctgagcggagacagacaagtggaagagtggccgaaagctacctgcacaggcgattgtcccgagcgctgcgggtgtacctcctctacgtgcctccataaggaatggcctcacagccggaactggagatgtaatcccacatggtgctggggagttggcaccgggtgtacatgctgtggactggacgtgaaggatctgttcaccgactacatgtttgtcaaatggaaggtggagtatatcaaaaccgaagccattgtttgcgtggagcttacatcccaggaacggcagtgttctctcatcgaggcgggcacgcgcttcaacctggggcctgtcaccattacactgagcgagcccagaaatatccagcaaaagctcccgcctgaaatcattaccctgcatccccggatcgaggaaggctttttcgaccttatgcacgtgcagaaagttctgtccgcttctacagtgtgcaagctccagagctgcacccatggagtccctggcgatcttcaggtgtaccacattgggaacctgcttaagggagacaaagtgaatggccacctcatccataagattgagccccactttaacacgtcctggatgagctgggatgggtgtgacctggattattactgcaatatgggagactggccttcttgtacatataccggcgtcacccaacataaccacgcctccttcgttaatctgctcaacatcgaaacagattacaccaaaaactttcacttccatagcaagagagtgacagcccacggggacacgccccagctggatcttaaagctcgcccgacctatggcgccggagagatcacagtgctggtcgaggtggctgacatggaactccataccaagaaaattgagatctctggcctgaagttcgcctccctggcgtgcacagggtgttacgcctgctctagctccattagctgtaaggttcggatccacgtggatgaacctgacgagcttaccgtccatgtgaaatccgatgaccccgacgttgtggctgccagctctagcctgatggctagaaagctcgagtttggaacggattccaccttcaaagccttttctgcgatgcccaagacaagcctgtgcttctacattgtcgaacgcgagcactgtaaatcctgctctgaagaggacaccaagaagtgtgtgaatacaaaactcgaacagcctcagagcatcctgattgagcacaagggcaccatcatcgggaaacaaaactccacatgcaccgccaaggcttcttgctggcttgagagcgttaaatcctttttctatggactgaagaatatgctcagcggcatttttgggaacgtgttcatgggcatctttctgttcctggccccgtttattcttctgatcctcttctttatgttcggatggcggattctgttctgttttaagtgctgtagacgcacgagaggcctcttcaaataccggcatctgaaggatgacgaagagacagggtatcgcagaatcatcgaaaaacttaataacaagaaaggaaagaataagctgctcgatggcgagcggctggctgacgggcgcattgccgaactgttttctaccaaaacccacatcggatga

SEQ ID NO: 16917 - RNA, 2973 nt, synthetic construct
  misc_feature 1..2973: note = derived and/or modified CDS sequence (opt5) from CCHVF(10200)__U39455.2__IgE-leader_Gn-4aa-Gc
  source 1..2973: mol_type = other RNA
atggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaaacttctgcaagtgtctgagtccacaggagtggctctcaagcggagctcctggctgatcgtcctgctcgtgctgttcacggtttctcttagccccgtgcagtccgcccctattggcagaaagcccctgtttctcgatagcaccgctaaagggatgaagaatctgcttaactctacatccctggagaccagcctctctatcgaagccccgtggggagcgattaatgtccagagcacatataaacctaccgtgtccacggccaacatcgctctgtcttggagctccgttgagcaccgcggcaataagatcctggtgagcgggcggtctgaatccattatgaagctcgaggaaagaacaggaatcagctgggacctgggcgtcgaggatgcctctgagtccaaacttctgaccgtgagcgtcatggacctctcccagatgtactctcccgtgttcgaatatctgagcggcgatcgccaagttgaggaatggcctaaggctacctgtacaggggactgccccgagcggtgtggatgcacctcctctacatgtctgcataaagaatggccccacagcagaaactggcgctgcaaccctacgtggtgctggggcgtggggaccggatgtacatgctgtggccttgatgtcaaggacctctttaccgattacatgttcgtgaaatggaaggttgagtatattaagacagaggccatcgtgtgcgtcgaactgacctcccaggagcggcagtgtagcctgattgaagccgggacgagatttaatctcggcccggtgaccatcacactgtctgagccccgcaacattcaacagaaacttcctcccgagatcatcaccctgcatcctcggattgaagagggattcttcgacctcatgcacgtgcagaaggttctgtccgctagcacagtctgcaaactgcagtcttgtacccacggcgtgcccggggatcttcaagtgtaccatatcggaaatctcctgaagggcgacaaagtcaacgggcacctgattcataagatcgaaccgcactttaatacgtcctggatgagctgggacggatgcgatctcgactattactgtaacatgggcgattggccttcttgcacatacaccggggtgacacagcataatcacgcgagcttcgttaacctgcttaatattgagaccgactataccaagaactttcacttccattccaaaagagtgacagcccacggcgatacgccccagctggacctcaaggctcgccctacctacggagccggcgaaatcacagtcctggtggaggttgccgatatggagctgcataccaaaaagatcgaaattagcgggcttaaatttgcttctctcgcctgtacaggatgctatgcgtgctccagctccatctcttgtaaggtgcggattcacgtcgacgagcccgatgaactgaccgtgcacgttaagagcgacgatcctgacgtggtcgctgcctcctctagcctgatggccagaaaactcgagttcggcacggattccacatttaaggctttctctgccatgcccaaaaccagcctgtgcttttacatcgtggaacgggagcattgtaagtcctgcagcgaggaagacaccaaaaagtgtgtgaatacaaaacttgagcagccgcaatctattctgatcgaacacaaggggaccatcattggaaagcagaactccacatgcacggctaaagccagctgttggctcgagtctgtcaagtccttcttttatggcctgaaaaatatgctgagcgggatcttcggcaacgtttttatgggaattttccttttcctcgcgccttttatcctgctgattctcttctttatgttcggctggcgcatcctgttttgcttcaagtgttgcagacggaccagagggctttttaaataccgccatctgaaggacgatgaagagacaggatatcggagaatcattgagaagctcaataacaaaaagggcaaaaacaagctgctggacggggaacgccttgccgatggaagaatcgctgagctgttctctaccaaaacacacattggctga

SEQ ID NO: 16918 - RNA, 1029 nt, synthetic construct
  misc_feature 1..1029: note = derived and/or modified CDS sequence (opt5) from CCHVF(10200)__U39455.2__IgE-leader_Gn
  source 1..1029: mol_type = other RNA
atggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaaacttctgcaagtgtctgagtccacaggagtggctctcaagcggagctcctggctgatcgtcctgctcgtgctgttcacggtttctcttagccccgtgcagtccgcccctattggctga

SEQ ID NO: 16919 - RNA, 1989 nt, synthetic construct
  misc_feature 1..1989: note = derived and/or modified CDS sequence (opt5) from CCHVF(10200)__U39455.2__IgE-leader_Gc
  source 1..1989: mol_type = other RNA
atggactggacctggatcctgttcctcgtggccgctgccacaagagtccacagctttctggattccacggcgaagggcatgaaaaaccttctcaattctaccagcctggagacatccctgtctattgaagctccctggggagccatcaacgttcagagcacctacaagcctacagtgtccaccgccaatattgctctttcttggagctccgtggagcatcgggggaacaaaatcctggtcagcggccgctctgaatccattatgaagctcgaggaaagaacagggatcagctgggacctgggagtggaggatgcctctgagtccaaactgctcaccgttagcgtgatggacctgtctcaaatgtattccccggtcttcgaataccttagcggcgatcgccaggtggaggaatggcccaaggctacgtgcaccggggactgtcctgagcggtgcggatgtacatcctctacctgcctgcacaaggagtggccccatagcagaaattggcggtgtaaccctacatggtgctggggcgttggcaccgggtgtacgtgctgtggactcgatgtgaaagacctgtttacagattatatgttcgtcaagtggaaagtggaatacatcaagaccgaggccattgtgtgcgtcgaacttacatcccaggagcgccagtgtagcctgatcgaagcgggcaccagatttaatctcgggcccgttaccattacactgtctgagcctcggaacatccaacagaaactgccgcccgagattatcacgctccaccctcgcattgaagagggattctttgacctgatgcatgtgcagaaggtgctttccgccagcaccgtctgcaagctgcagtcttgcacacacggcgtgcccggggatctccaagtttatcacatcggaaatctgcttaaaggcgacaaggtgaacggccatctgatccacaaaattgaacctcatttcaataccagctggatgtcctgggatgggtgtgacctcgactactattgcaacatgggagattggccctcttgtacatacaccggcgtcacgcagcacaatcacgctagctttgtgaacctgctgaatatcgagacagactacaccaagaacttccattttcactccaaaagagttaccgcccatggggatacaccgcagctcgacctgaaggctcggcctacctatggagccggcgaaattacagtgcttgtcgaggtggcggatatggagctgcacacgaaaaagatcgaaattagcgggctcaagttcgcctctctggcttgcaccggatgttacgcctgctccagctctatctcctgtaaagtccgcatccatgtggacgagcccgatgaacttacagttcacgtgaagtccgacgatcctgacgtcgtggctgcctcctctagcctgatggccagaaaactcgagtttggcaccgattccacattcaaggctttctctgcgatgcccaaaaccagcctgtgcttttatattgttgaacgggagcactgtaagtcctgcagcgaggaagacacgaagaaatgtgtgaacaccaagctggagcagccccaatctatcctcattgaacataaaggcacaatcattgggaagcagaatagcacatgcaccgccaaagctagctgctggctggagtctgtcaagtccttcttttacggacttaagaacatgctgagcggcatcttcgggaatgtgtttatgggaatcttcctctttctggcccctttcattctgcttatcctctttttcatgtttggctggcgcattctgttctgttttaaatgctgtagacggaccagagggctgttcaagtatcgccacctcaaagacgatgaggaaacgggctaccggagaatcattgagaagctgaacaataaaaagggaaagaacaaacttctggacggcgaacgcctcgccgatgggcggatcgctgagctgttctctacaaagacccatattggatga

SEQ ID NO: 16920 - RNA, 1449 nt, synthetic construct
  misc_feature 1..1449: note = derived and/or modified CDS sequence (opt11) from CCHFV(10200)__NC_005302.1/U88410.1__N
  source 1..1449: mol_type = other RNA
atggaaaacaaaatcgaggtgaacaacaaagacgaaatgaaccgatggttcgaagagttcaagaaaggcaacggacttgtagacacgttcaccaactcctactccttctgcgaatcagtccccaacctagaccgattcgtcttccaaatggccagcgcaacagacgacgcacaaaaagactcgatatacgcatccgccctagtagaagcaaccaaattctgcgcccccatctacgaatgcgcttgggtatctagcacaggaatcgtcaagaaaggactcgaatggttcgagaaaaacgccggcacaatcaaatcctgggacgaatcatacaccgaactaaaagtagacgtacccaaaatagaacaactcaccggctaccaacaagccgcactaaaatggcggaaagacatcggcttccgcgtcaacgccaacaccgccgccctctccaacaaagtcctagccgaatacaaagtccccggcgaaatcgtcatgtccgtcaaagaaatgctctccgacatgatcagacggcgcaacctcatccttaaccgcgggggagacgaaaatccccgcggacccgtctctcacgaacacgtcgactggtgccgcgagttcgtcaaaggcaaatacataatggcgttcaacccaccctggggagacataaacaaatcaggccggtcaggcatcgccctcgtcgccaccggactagccaaactcgcagaaacggaaggcaagggcatattcgacgaagctaagaaaaccgtcgaggcacttaacggatacctagacaaacacaaagacgaggtcgaccgagccagcgcagacagcatgataaccaacctactgaaacacatcgcaaaagcgcaagaactatacaaaaactcctcagccctccgagcccaaagcgcacaaatcgacacagcattctccagttactactggctctacaaagcaggagtcacccccgaaacattccccacagtcagccaattcctcttcgaactaggaaaacaaccccgaggcacaaagaaaatgaagaaagcgttactcagcacccccatgaaatggggcaagaaactatacgaactcttcgccgacgactccttccaacaaaaccgcatatacatgcacccggccgtacttaccgcaggacgcatatcagagatgggcgtctgcttcggtaccatccccgtggccaacccagacgacgcagcacaaggatctggccacaccaaaagcatcctcaacctccgcacaaacaccgaaaccaacaacccatgcgcaaaaacaatagtcaaactattcgaagtccaaaagaccggcttcaacatccaagacatggacatcgtcgcatctgaacacctactccaccaaagcctggtcggaaaacaatcccccttccaaaacgcctacaatgtcaaaggcaacgcaacctccgccaacatcatctag

SEQ ID NO: 16921 - RNA, 1449 nt, synthetic construct
  misc_feature 1..1449: note = derived and/or modified CDS sequence (opt11) from CCHFV(Turkey-Kelkit06)__GQ337053.1__N
  source 1..1449: mol_type = other RNA
atggaaaacaaaatagaagtcaactccaaagacgaaatgaacaaatggttcgaagaatttaaaaaaggcaacggcctaatggacacattcaccaactcttactccttctgcgaaaacgtccccaacctcgacaaattcgtcttccaaatggcctccgccaccgacgacgcccaaaaagactcaatctacgcctccgccctagtcgaagccacgaaattctgcgccccaatctacgaatgcgcctgggtaagctccaccggcatagtgaaaaagggcttagaatggttcgagaaagactccggaaccataaaatcatgggacgaaaactacgcagaactcaaagtagacgtacccaaaatcgagcaactcgccaactatcagcaagcagccctaaaatggcgcaaagacataggtttccgcgtaaacgccaacaccgccgccctctcaaacaaagtcctcgccgaatacaaagtcccgggagaaatcgtgatgtcagtcaaagaaatgctaagcgacatgatccgccgccgcaatctaatcctcaaccgcggtggagacgaaaacccccgagggcccgtcagccgagaacacgtcgaatggtgcagagaatttgtaaaaggcaaatacattatggcatttaacccaccatggggcgacatcaacaagtcaggacgaagtggaatcgcactcgtcgccacaggcctcgccaaactcgcagaaaccgaaggaaaaggcgtcttcgacgaagcaaaaaaaaccgtcgaggcccttaacggatacctcgacaaacaccgcgacgaagtcgacaaagcctccgcggactccatgataacaaacctcccaaaacacatcgcgaaagcccaagaactctacaaaaactcctcagcactcagagcccaaggagcccaaattgacaccccgttctccagcttctactggctttacaaagcaggcgtcacccccgaaacattccccaccatcagccagttcctattcgaactcggagaacaaccaagaggaacaaaaaaaatgaaaaaggccctcctctccacacccatgaaatggggaaaaaaactgtacgaactcttcgccgatgactcattccaacaaaaccgcatctacatgcaccctgccgtcctcaccgccggccgcataagcgaaatgggggtctgcttcggcaccatacccgtcgccaatccagacgatgcagcccaaggctccggacataccaaaagcatcctgaacctccgaaccagcacagaaaccaacaacccctgcgccaagacaatcgtcaagctatttgaaatccaagaaaccggcttcaacatacaggacatggacatcgtcgcctcggaacacctcctccaccaatccatcgtcggaaaacaaagtcccttccagaacgcatacaacgtcaaaggcaacgccacatccgccaacatcatctaa

SEQ ID NO: 16922 - RNA, 5055 nt, synthetic construct
  misc_feature 1..5055: note = derived and/or modified CDS sequence (opt11) from CCHFV(10200)__U39455.2__GP
  source 1..5055: mol_type = other RNA
atgcacatcagcctgatgtacgccatcttatgcctacagctgtgcggcctcggggaaacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgatgtcgacccctccacccagacggccgggggcaccagcgcccccaccgtgcggacgtccctgccgaacagcccctcgacgcccagcacgccccaggacacccaccacccggtgcgcaacctcctgtccgtcaccagccccgggcccgacgagaccagcaccccgtccggcaccggcaaggagagctccgccaccagctccccgcacccagtgagcaaccggcctcccacgccacccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctaacgctcgaggaggacacggagggcctgctcgaatggtgcaagcggaacctcgggctggactgcgacgacaccttcttccagaagcggatcgaggagttcttcatcaccggcgaggggcacttcaacgaggtgctgcagttccggacgcccggcaccctctccactaccgagagcacgccggccgggctgcccaccgccgagcccttcaaatcctacttcgccaagggtttcctgagcatcgactccggctactacagcgccaagtgctacagcgggacctccaacagcggcctccagctgatcaacatcacccgccactccactcggatcgtagacacccccgggccgaagatcacgaacctgaagaccatcaactgcatcaacctcaaggcgagcatcttcaaggagcaccgagaggtggagatcaacgtgctgctgccccaggtggccgtcaacctctccaactgccacgtggtgatcaagagccacgtgtgcgactactccctggacatcgacggcgccgtgcggctgccccacatctaccacgagggggtgttcatccccggcacgtacaagatcgtcatcgacaagaagaacaagctcaacgaccgctgtacccttttcaccgactgcgtgatcaagggacgggaggtgcgcaagggccagagcgtcctgcggcagtacaagactgagatccgcatcggcaaggcctccaccgggttccggcgcctcctgagcgaggaaccgtccgacgactgcgtgagccggacccagctgttacgcacagagaccgccgagatccacggcgacaactacgggggccccggcgacaagatcacgatctgcaacgggtccaccatcgtcgaccagcgcctgggcagtgaactggggtgctacaccatcaaccgggtgcgctccttcaaactgtgcgagaacagcgcgaccggcaagaactgcgagatcgactccgtgcccgtcaagtgccggcagggctactgcctccgcatcacgcaggaggggcgtggccacgtgaagctgagccgcgggagcgaggtggtcctggacgcctgcgacacctcctgcgagataatgatccccaagggcaccggggacatcctagtggactgcagcgggggccagcagcacttcctgaaggacaacctgatcgacctcgggtgcccgaagatccccctgctgggcaagatggccatctacatttgccggatgtccaaccaccccaagaccacgatggccttcctcttctggttcagcttcgggtacgtgatcacgtgcatcctgtgcaaggctatcttctacctgctcatcatcgtcggcaccctggggcgccggctgaagcagtaccgtgagctcaagccccaaacctgcaccatctgcgagaccaccccggtaaacgcgatcgacgccgagatgcacgacctgaattgctcctacaacatctgcccctactgcgcctcccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgtttaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaagggtctggtggacagcgtcggtaactccttcttccccggcctgagcatctgcaagacgtgcagcatctccagcatcaacgggttcgagatcgagtcccacaagtgctactgcagcctcttctgctgcccgtactgtcggcactgctccaccgacaaggagatccacaaactgcacctgagcatctgcaagaagcgcaagaccggctccaacgtgatgctcgctgtgtgcaaactgatgtgcttccgcgcgaccatggaggtaagcaaccgggccctgttcatccgctccatcatcaacacgaccttcgtgctctgcatccttatcctggccgtgtgcgtcgtgagcacctccgccgttgagatggagaacctccccgccgggacctgggagcgggaggaggacctgacgaacttctgccaccaggagtgccaagtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcatggagcagcgtggagcaccggggaaacaaaatcctcgtgtccggccgcagcgagtccatcatgaagctggaggagcggaccggtatcagctgggaccttggagtcgaggacgcctccgagagcaagctcctgaccgtgtccgtgatggacctaagccaaatgtactcccccgtcttcgagtacctcagcggggaccgccaggtggaagaatggcccaaggcgacctgcacgggcgactgcccggagcggtgcggctgcacctccagcacgtgcctgcacaaggagtggccccactcccgcaactggaggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccaatgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtgtgcaagctccagtcctgcacccacggggtgcccggcgacctccaggtgtaccacatcgggaacctgctgaagggcgacaaggtcaacgggcacctgatccacaagattgagccccacttcaacactagctggatgagctgggacggctgcgatctggactactattgcaacatgggcgactggccctcctgcacctacacaggggtgacccagcacaaccacgccagcttcgtgaacctcctgaacatcgagaccgactacaccaagaacttccacttccactccaagcgcgtcacggcccacggcgacacgccccagcttgacctcaaggcccggccgacctacggggcgggcgagatcaccgtgctggtggaggtagccgacatggagctgcacaccaagaagatcgagatcagcgggctcaagttcgcctccctggcctgtaccggctgctacgcctgcagctccagcatctcctgcaaagtgcgcatccacgtggacgagcccgacgagctaaccgtccacgtcaagagcgacgaccccgatgtggtggcggcctcgtcttccttaatggcccggaagctggagttcggcaccgactcgacgttcaaggccttctccgccatgcccaagaccagcctgtgcttctacatcgtggagcgcgagcactgcaagtcctgcagcgaggaagacaccaagaaatgcgtgaacaccaagctcgagcagccgcaatccatcctgatcgagcacaaggggacgatcatcggcaagcagaactccacgtgcaccgcgaaagccagctgctggctggaaagcgtcaagagcttcttctacgggctgaagaacatgctctccggcattttcggcaacgtgttcatggggatctttctgttcctggcccccttcatcctcctgatcctgttcttcatgttcggctggcggatcctcttctgcttcaagtgctgccgccgcacccgggggctgttcaagtaccgccacctgaaagacgacgaggagaccggctaccggcgcattatcgaaaagctcaacaacaagaaggggaagaacaagctgctggacggtgagcggctcgccgacggccgcattgccgagctgttcagcaccaagacccacatcgggtaa

SEQ ID NO: 16923 - RNA, 5055 nt, synthetic construct
  misc_feature 1..5055: note = derived and/or modified CDS sequence (opt11) from CCHFV(IbAr10200)__AF467768.2__GP
  source 1..5055: mol_type = other RNA
atgcacatcagcctgatgtacgccatcctctgcctgcagctgtgcggcctcggggagacccacggctcccacaacgagacccgccataacaaaaccgacaccatgacgacgcccggggacaacccgagctccgagccgcccgtcagcaccgccctgtcgatcaccctggaccccagcactgtcacgccgacgacccccgcgtccggcctcgaggggagcggagaggtatacacctcaccgcccataaccacgggcagcctgcccctgtccgagaccacccccgagctccccgtgaccacgggaaccgacaccctcagcgccggcgacgtcgacccctccacccagacggccgggggcaccagcgccccgaccgtgcggaccagcctgcctaactctccctccacgcccagcacgccgcaggacacccaccaccccgtgcgcaacctcctgtccgtcaccagccccgggcccgacgagacgagcaccccgtccggcaccgggaaggaaagctccgccacaagcagcccccaccccgtgagcaaccggcccccgaccccgcccgcgaccgcccagggtcccacagagaacgactcccacaacgccaccgagcacccggagagcctgactcagtccgccacccccggcctcatgaccagccccacccagatcgtgcacccgcagtccgcgacccccatcacggtccaggatactcaccccagtcccacgaaccgctccaagcgaaacctgaagatggagatcatcctgaccctcagccaggggctgaagaagtactacggcaagatcctgcgcctcctgcagctgacgctagaggaggacaccgagggtctgctggagtggtgcaagcggaacctcgggctggactgcgatgacaccttcttccagaagcgcatcgaggagttcttcatcaccggcgaggggcacttcaacgaggtgctgcagttccgaacgccgggaaccctctccaccacagagagcacgcccgccgggctgcccacggccgagcccttcaagtcctacttcgccaagggcttcctgagcatcgactccggttactacagcgccaagtgctacagcgggacgtccaacagcggcctccagcttatcaacatcacccgccactccacgcggatcgtcgacaccccggggcccaagatcaccaacctgaagaccatcaactgcataaacctcaaggcgagcatcttcaaggagcaccgcgaggtcgagatcaacgtgctgctgccccaggtggccgtaaacctctccaactgccacgtagtgataaagtcacacgtctgtgactacagtctggacatcgacggcgccgtgcggctgccccacatctaccacgagggggtgttcatccctggcacgtacaagatcgtcatcgacaagaagaacaaactcaacgaccgctgcaccttattcacagactgcgtgataaagggccgggaggttcgcaaggggcaaagcgtcctgcggcagtacaagaccgagatccgcatcgggaaggcctccacggggagccggcggctcctgtccgaggagcccagcgacgactgcatttcccggacccagctgctccgcaccgaaaccgccgagatccacggcgacaactacgggggccccggcgacaagatcacgatttgcaacggcagcaccatcgtggaccagcgcctgggctccgagctagggtgctacacgatcaaccgtgtccgcagcttcaagctgtgcgagaactcggctaccggcaagaactgcgagattgactcagtgcccgtgaagtgccggcagggctactgcctccgtatcactcaggaggggcggggccacgtgaagctgagccgcgggtccgaggtggtgctcgacgcctgcgacaccagctgcgagatcatgatccctaagggcaccggggacatcctcgtcgactgctccggcggccagcagcacttcctcaaggacaacctgatcgatctcgggtgtcctaagatccccctgctgggcaagatggccatctacatctgccggatgagcaaccaccccaagaccacgatggcattcctcttctggttctccttcgggtatgtgatcacctgtatcctctgcaaggctatcttctacctccttatcatcgttggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgtctgaccagcgacgggctcgcccggcacgtgattcagtgccccaagcgcaaagaaaaggtggaggagaccgagctgtacttaaacctcgaacggatcccgtgggtcgtgcgcaagctgctgcaggtatccgagagcacgggcgtcgccctcaagcggtccagctggctgatcgtactgctcgtgctgttcaccgtctccctgagccccgtacagtccgcgcccatcgggcagggcaagaccatagaagcgtaccgcgcccgggaggggtacacttctatttgcctcttcgtgctgggctccatcctgttcatcgtcagttgtctcatgaaggggctcgtggactcagtgggcaacagcttcttcccgggcctgagcatctgcaagacgtgctcgatcagctccatcaatgggttcgagatcgagagccacaagtgctactgctccctcttctgctgcccctactgccgccactgcagcaccgacaaggagatccacaagctgcacctgtctatatgcaagaagcggaagaagggcagcaacgtcatgttagccgtttgcaagctgatgtgcttccgcgcgaccatggaggtgtccaaccgcgccctgttcatccggagcatcatcaacactacgttcgtcctctgcatactgatactggccgtgtgtgtggtctccaccagcgccgtggagatggagaacctccccgccgggacctgggagcgcgaggaagacctgaccaacttttgccaccaagagtgccaagtgacggagaccgagtgcctgtgcccctacgaggcgctcgtcctgcggaagccgctgttcctcgactccaccgccaagggcatgaagaacctgctgaacagcacatccctcgagacaagcctgtccatcgaggccccctggggcgccatcaacgttcagagcacatacaagccgaccgtgtccaccgctaacattgcactgagctggagctccgtcgagcaccgcgggaacaagatcctcgtgagcggccgatccgagagcatcatgaagctggaggagcgcacggggatctcctgggacctgggcgtggaggacgccagcgagtccaagctcctgaccgtcagcgtcatggacctgtctcagatgtacagcccggtgttcgagtacctcagtggggaccggcaggtcggagagtggccgaaggcaacctgcaccggcgactgccccgagcgctgcgggtgcacgagctcgacttgcctgcacaaggagtggccccatagccggaactggcgctgcaaccccacctggtgctggggcgtggggaccggctgcacgtgctgcgggctggacgtcaaagacctctttaccgactacatgttcgtaaagtggaaggtggagtatatcaagaccgaggccatcgtgtgcgtcgagctgaccagtcaggaacggcagtgtagcctgatcgaggccggcacgcgattcaacctcggcccggtgaccataaccctgtccgagccccggaacatccagcagaagctgcccccggagatcatcaccctccacccgcgcatcgaagaagggttcttcgacctgatgcacgtccagaaggtactgagcgccagtacagtgtgcaagctccagtcctgcacgcatggcgtcccaggggacctccaggtgtaccacatcggcaatctgctgaaaggggataaggtgaacggccacctgatccacaaaatagagccccacttcaacaccagctggatgtcctgggacggctgtgacctggactactactgcaacatgggggactggcccagctgcacctacaccggcgtcacgcagcacaaccacgcctccttcgtcaacctcctgaacatcgagaccgactacaccaagaacttccacttccacagcaagcgtgtgaccgcccacggggacacgccgcagttagacctcaaagcccgccccacgtacggcgcgggggagatcaccgtactggttgaggtggccgatatggagctgcacactaagaagattgaaatctccggcctcaagttcgcctcgctggcctgcacgggctgctacgcctgctcctcagggatctcctgcaaggtccggatccacgtagacgagcccgacgagctgacagtgcacgtcaagagcgacgaccccgacgtggtggcggcctccagctccctcatggcccgcaagctggagttcggcaccgacagcacctttaaggccttctccgccatgccgaagacgagcctgtgcttctacatcgtcgagcgggagcactgcaaatcctgcagcgaggaggacaccaagaagtgcgtgaacaccaaactcgagcagccccagtccatcctgatcgagcacaaggggaccatcataggcaaacagaacagcacgtgcaccgcgaaggccagctgctggctggagtccgtgaagtccttcttctacggcctgaagaacatgttatccgggatcttcggcaacgtcttcatggggatcttcttgttcctggcacccttcattctccttatcctgttcttcatgttcggctggcgcatcctcttctgcttcaagtgctgccgccgcacccgcgggctgttcaagtaccggcacctgaaggacgacgaggagaccggatatcgccggatcatcgagaagctcaacaacaagaagggcaagaacaagctgctggatggcgagcgcctcgccgaccggcgcatcgccgaactgttcagcacgaagacccacatcggctga

SEQ ID NO: 16924 - RNA, 5067 nt, synthetic construct
  misc_feature 1..5067: note = derived and/or modified CDS sequence (opt11) from CCHFV(Turkey-Kelkit06)__GQ337054.1__GP
  source 1..5067: mol_type = other RNA
atgcccaccaacattatgcacaccccgctggtgtgcttcatcctctacctgcagctgttatgcctgggcggggcccacggccaactgaacgccacggagcacaacgggaccaacaacacaacggcgcccggcgccagccagtcccccaaacccccgatgagcactacaccaccccacgcccccgagtccagcaccatcaagccgaccacgccaatttccgaggccgaggggagcggagagaccacctccccgcccaataccacgcagggcctcagttcccccgagaccaccagcgagcgccctgccaccacgtccatcagcacttccagcaccgactccaccaaccccacgacgcagatgaccgacaacacccccactccgaccgtctcgacctcccccagctccagccccagcaccccctccactccgcaggggatccaccacccagcgcggagcctgctgtccgtttcttcccccaagaccgtgaccacccccacgccgaccagccccggtgagatgtccagcgagacctccagccagcacagcgccatgagccgcatccccactccccacaccgcgacccgggtatccaccgagatcaccaaccaccgcaccccgcggcagagcgagtcaagcgcccagcagacgacgccttcccccatgaccagcccggcgcagtccatcctcctgatgagcgccgcacccaccgccgtgcaggacatccaccccagcccaacgaaccgctccaagcggaacctggaaaccgagatcatcctcaccctcagccaggggctgaagaagtactatggcaagattctcaagctcctgcacctcaccctggagcaagacacggaggggctgctcgaatggtgcaagggcaacctgggctccaactgcgacgacgacttcttccagaagaggatcgaggagttcttcatgaccggggagtgctacttcaacgaggtgctgcagttcaagaccctcagcaccctgtccccgaccgagcccagccatgcccggctgcccaccgcggagcccttcaagtcctacttcgccaaggggttcctgagcatcgactccgggtatttcagcgccaaatgctacccgcgctccagcgcctcaggcctgcagctgatcaacgtcacccagcaccccgcccggatcgctgagacccccggccccaaaacgactagcctcaagaccatcaactgcatcaatctgcgcgcctccgtgttcaaggagcacagagaggtggaaatcaacgtgctgctcccgcagatagccgtgaacctgagcaactgccacgtggtcatcaactcccacgtgtgcgactacagcctggacaccgacgggcccgtgcgtctcccccgcatctaccacgagggcacgttcatccccgggacatacaagatcgtcatcgacaagaagaacaagctgaacgaccgctgcacgctggtgacgaactgcgtgatcaagggccgggaggtccgcaaagggcagagcgtgttgcgtcagtacaagaccgagatcaagatcggcaaggcctccaccgggttccgcaagctgctgagcgaggaaccgggggacgactgcatctcccggacccaactcttgcgcaccgagacggctgagatccacgacgacaactacggcgggcccggcgacaaaatcaccatctgcaacggctcaactattgtggaccagagactgggctccgagttaggctgctacaccatcaaccgggtcaagagctttaagctgtgcaagaactccgcgacggggaagacctgcgaggtcgacagcacccccgtgaagtgccgtcagggcttctgtctcaagattacccaggaggggcggggccacgtgaagctgtcccgcgggtcagaggtggtactggacgcctgcgactccagctgcgaggtgatgatccccaagggcacgggcgacattctagtggactgcagtgggggtcaacaacactttctaaaagacaacctcatcgacctggggtgcccgcacatccccctgctcggccggatggccatctatatctgccgcatgagcaaccacccccggaccactatggccttcttgttttggttctcctttggctacgtgattacctgcatcttctgcaaggccctgttctattcgctcatcatcatcggaaccctgggtaagaagatcaagcagtaccgcgagctgaagccccagacgtgcaccatctgcgagaccgcgccggtgaacgccatcgacgccgagatgcacgacctcaactgctcctacaacatctgcccctactgcgcgagcaggctgacctccgacggactggcgcgccacgtgacgcaatgccccaagcggaaggagaaggtcgaggagaccgagctctacctgaacctggagcgcatcccgtggatcgtgcggaagctcttacaggtgagcgagagcaccggcgtcgccctgaagcgctccagctggctgatcgtgctgctggtactcctgaccgtctccctgagccccgtgcagtccgcccccgtcgggcacggcaagacgatcgagatctaccagacccgggagggcttcgctagcatctgcctcttcatgctggggtccatcctattcatcgtcagctgcctcgtgaagggcctggtggactccgttagcgagtccttcttccccgggctgtcggtgtgcaagacatgctccatcggcagcgtgaacgggttcgagatcgagtcccacaagtgctactgcagcctcttctgttgcccgtactgccgtcactgcagtgccgaccgggagatccaccagcttcatctgagcatctgcaagaagcgcaagaccggctccaacgtcatgctcgctgtgtgcaagcggatgtgcttccgcgccacgatcgaggcaagccgtcgggctctgctgatacgcagcataatcaacaccaccttcgtgatctgcatcctcaccctgacgatctgcgtcgtgtccaccagcgccgtggagatggagaacctgcccgccggcacctgggagcgggaagaggacctcaccaacttctgccaccaggagtgccaggtcacggagaccgagtgcctgtgcccctatgaagccctggtgctccgcaagcccctgtttctggactccatcgtgaaggggatgaaaaacctcctgaacagcacctccctggagaccagcctgtccatcgaggccccgtggggcgccatcaacgtgcagagcacattcaagcccaccgtgtccactgccaacatcgcgctgagctggtctagcgtggtccaccgggggaacaagatcctggttaccggccgctccgagagcatcatgaagctcgaggagcggacgggggtatcctgggacctgggcgtagaggacgccagcgagtcgaagctgctcaccgtgagcatcatggacctgtcccagatgtacagccccgtgttcgagtatctgagcggcgaccgccaggtagaggagtggcccaaggctacctgcaccggtgactgcccggagcggtgcggctgcacgtcgagcacctgtctccacaaggaatggtcccacagccgcaactggcggtgcaaccccacctggtgctggggcgtggggaccggatgcacgtgctgcggcgtggacgtcaaggacctatttaccgaccacatgttcgtgaagtggaaggtggaatacatcaaaaccgaagccatcgtttgcgtggcgctgacctcccaggagcgccagtgcagcctcatcgaggccggaacccggtttaacctagggccggtgacgattaccctctccgagccccgcaacatccagcagaaactcccgcccgagattatcaccctgcaccccaaaatcgaggagggctttttcgatctgatgcacgtccagaaggtgctcagcgcctccaccgtgtgcaagctgcagagctgcacgcacgggatccccggcgacctgcaggtctaccatatcggcaacctcctgaagggggaccgcgtgaacggccacctgatccacaagatcgagtcccacttcaacaccagctggatgtcctgggacgggtgtgacctcgactactactgcaacatgggcgactggccgagctgcacctacaccggggtcactcagcacaaccacgccgccttcgtgaacctgctgaacatcgagaccgactacaccaagaccttccactttcactccaagcgcgtaacggcgcatggcgacacccctcagctcgacctgaaggcccggcccacctacggcgccgggggcatcaccgtcctggtcgaggtggctgacatggagctccacactaagaaggtcgaaatcagcggactgaagttcgcctccctcgcgtgcaccggctgctacgcctgcagcagtgggatcagctgcaaggtacgcatccacgtggacgagccggacgagctcactgtccacgtaaagagcagcgacccggacgtggttgccgcgtcgacctcactgatggcccggaaactggagttcggcacggactcaacgtttaaggcgttctccgccatgcccaagaccagcctctgcttctacatcgtggagcgcgagtactgcaagtcctgcagcgaggacgacacccagaagtgtgtggacacgcggctggagcaaccccagtccatactgatcgagcacaaaggcacaatcatcgggaagcagaacgatacctgcaccgccaaggccagctgctggctcgagtccgtcaagagtttcttctacggcctgaagaacatgctggggtccgtgttcggcaacctattcatcgggatcctcctgttcctcgcgcccttcgtgttactcgtcctgtttttcatgttcggctggaagatcctcttctgcttcaagtgttgccgccgcacgcggggcctgttcaagtaccgccacctgaaggacgacgaggagaccgggtaccggagaatcatcgagcgactcaatagcaagaagggcaagaaccgcctgctggacggggaccgactcgccgaccgcaagatagccgagctattctccaccaagacccacatcggctga

SEQ ID NO: 16925 - RNA, 3579 nt, synthetic construct
  misc_feature 1..3579: note = derived and/or modified CDS sequence (opt11) from CCHVF(10200)__U39455.2__SP-GP_Gn-NSm-Gc
  source 1..3579: mol_type = other RNA
atgcacatcagcctgatgtacgccatcctctgcctgcagctgtgcggcctcggggagacccacggctcccacaacgagaccagcgaggagccctccgacgactgcgtgagccgcacgcagctgctgcggaccgagaccgccgagatccacggggacaactacggcgggccgggcgacaagatcaccatctgcaacggctccacgatcgtcgaccagcgcctcgggagcgagctgggctgctacaccatcaaccgggtgcgctccttcaagctgtgcgagaacagcgcgaccgggaagaactgcgagatcgactccgtgcccgtcaagtgccggcagggctactgcctccgcatcacccaggaggggcggggccacgtgaagctgagccgcggctccgaggtggtcctggacgcctgcgacacgagctgcgagatcatgatccccaaggggaccggcgacatcctcgtggactgctccgggggccagcagcacttcctgaaggacaacctgatcgacctcggctgccccaagatcccgctgctggggaagatggccatctacatctgccggatgagcaaccaccccaagaccaccatggccttcctcttctggttctccttcggctacgtgatcacgtgcatcctgtgcaaggccatcttctacctgctcatcatcgtcgggaccctgggccgccggctgaagcagtaccgcgagctcaagccccagacctgcaccatctgcgagacgacccccgtgaacgcgatcgacgccgagatgcacgacctgaactgcagctacaacatctgcccgtactgcgcctcccggctgaccagcgacgggctcgcccgccacgtgatccagtgccccaagcggaaggagaaggtcgaggagaccgagctgtacctgaacctcgagcgcatcccctgggtggtgcggaagctgctgcaggtctccgagagcacgggcgtggcgctcaagcgcagctcctggctgatcgtgctgctcgtcctgttcaccgtgagcctgtcccccgtgcagagcgccccgatcggccaggggaagaccatcgaggcctaccgggcccgcgagggctacacctccatctgcctcttcgtcctggggagcatcctgttcatcgtgtcctgcctcatgaagggcctggtggacagcgtcgggaactccttcttccccggcctgagcatctgcaagacgtgctccatcagctccatcaacggcttcgagatcgagagccacaagtgctactgctccctcttctgctgcccctactgccggcactgcagcaccgacaaggagatccacaagctgcacctgtccatctgcaagaagcgcaagaccgggagcaacgtgatgctcgccgtctgcaagctgatgtgcttccgcgcgaccatggaggtgtccaaccgggccctgttcatccgcagcatcatcaacacgaccttcgtgctgtgcatcctcatcctggccgtctgcgtggtgagcacctccgccgtcgagatggagaacctgcccgccggcacctgggagcgggaggaggacctcacgaacttctgccaccaggagtgccaggtgaccgagaccgagtgcctgtgcccgtacgaggcgctggtgctccgcaagcccctgttcctggacagcaccgccaaggggatgaagaacctcctgaactccacgagcctggagacctccctcagcatcgaggccccctggggcgccatcaacgtccagtccacctacaagcccaccgtgagcaccgccaacatcgcgctgtcctggagctccgtggagcaccgggggaacaagatcctggtcagcggccgctccgagagcatcatgaagctcgaggagcggacgggcatctcctgggacctgggggtggaggacgccagcgagtccaagctgctcaccgtgagcgtcatggacctgagccagatgtactccccggtgttcgagtacctgagcggcgaccgccaggtggaggagtggcccaaggccacctgtaccggggactgccccgagcggtgcggctgcacgtccagcacatgcctccacaaggagtggccccactcccgcaactggcggtgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacgcggttcaacctggggcccgtcaccatcaccctcagcgagccccgcaacatccagcagaagctgcccccggagatcatcaccctgcacccccggatcgaggagggcttcttcgacctcatgcacgtgcagaaggtgctgtccgcgagcacggtctgcaagctgcagtcctgcacccacggcgtgcccggggacctccaggtgtaccacatcggcaacctgctgaagggggacaaggtcaacggccacctcatccacaagatcgagccgcacttcaacaccagctggatgtcctgggacgggtgcgacctggactactactgcaacatgggcgactggcccagctgcacctacacgggcgtgacccagcacaaccacgcctccttcgtgaacctgctcaacatcgagaccgactacaccaagaacttccacttccacagcaagcgcgtcacggcccacggggacaccccccagctggacctgaaggcccggcccacctacggcgcgggggagatcaccgtgctcgtggaggtcgccgacatggagctgcacacgaagaagatcgagatctccggcctgaagttcgccagcctcgcctgcaccgggtgctacgcctgctccagcagcatctcctgcaaggtgcgcatccacgtggacgagccggacgagctgaccgtccacgtgaagagtgacgaccccgacgtggtcgcggcctccagctccctgatggcccggaagctcgagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctggagcagccccagtccatcctcatcgagcacaagggcacgatcatcgggaagcagaacagcacatgcaccgcgaaggcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcgcatcctcttctgcttcaagtgctgccggcgcacccggggcctgttcaagtaccgccacctgaaggacgacgaggagaccgggtaccggcgcatcatcgagaagctcaacaacaagaagggcaagaacaagctgctggacggggagcggctcgccgacggccgcatcgccgagctgttctccacgaagacccacatcggctga

SEQ ID NO: 16926 - RNA, 3552 nt, synthetic construct
  misc_feature 1..3552: note = derived and/or modified CDS sequence (opt11) from CCHVF(10200)__U39455.2__IgE-leader_Gn-NSm-Gc
  source 1..3552: mol_type = other RNA
atggactggacctggatcctgttcctcgtggcagccgcgactcgcgtacactcatccgaggagcccagcgacgactgtgtgtccagaacgcagctgttgcgcacggagacggccgagatccacggcgacaactacgggggcccgggggacaagatcaccatatgcaacggcagcaccatcgtagaccagcggctcgggtccgagctaggctgttacaccatcaaccgtgtccggagcttcaagctgtgcgaaaattcagccaccggcaaaaactgcgagatcgacagcgttcccgtgaagtgtcgccaggggtactgcctccggatcacccaggagggcagagggcacgtcaagttatctcggggcagcgaggtagtgctggacgcgtgcgacacgtcctgcgagatcatgatacccaaggggaccggcgacatcctcgtcgactgcagcggcgggcaacagcacttcctgaaggacaacctgatcgatctcggctgccccaagatcccgctactggggaaaatggccatctacatctgccgaatgtccaaccacccaaagaccaccatggcgttcctcttctggttcagcttcgggtacgtgatcacatgcattctgtgcaaggccatcttctacctgctcatcatcgtgggcaccctggggcggcgcctgaaacagtacagagagctcaagccccagacctgcaccatctgcgagaccaccccggtcaacgcgattgatgccgagatgcacgacctaaactgttcctacaacatctgcccgtactgcgcgagccgcctgacgtccgacggcctcgcccggcacgtgatccagtgccccaagcgcaaggagaaggtggaggagaccgagttatacctcaacctagagcggatcccttgggtcgttcggaagttgctccaggtgagcgagtccacgggggttgccctcaagaggagcagctggctgatcgtgctgctcgtactgttcaccgtcagtctgagccccgtgcagtccgctccgatcgggcaggggaagaccatcgaggcgtatcgggccagggagggctacaccagcatctgcctcttcgtcctgggctccatcctgttcatcgtcagctgcctgatgaaggggctggtggacagtgtcggcaacagcttcttccccgggctaagcatctgcaagacgtgcagcatctcctccatcaacggcttcgagatcgaatcccacaagtgctactgctccctcttctgctgcccctactgccgccattgctccaccgacaaggagatccacaagctgcacctgtcaatctgcaagaagaggaaaaccgggtccaacgtgatgctagccgtgtgcaagctgatgtgtttccgggctaccatggaggtcagcaaccgcgccctgttcattaggtccattatcaataccactttcgtgctctgcatcctgatcctggcggtgtgcgtcgtgagcaccagcgcagtggaaatggagaacctacctgccggcacctgggagcgggaggaggatctcacgaacttctgccaccaggagtgtcaggtcacagagaccgagtgcctttgcccgtacgaggccctggtactcaggaagcccctgtttctggactccaccgccaagggcatgaaaaacctcctgaactccacatccctggagaccagcctctccatagaggccccctggggcgcgatcaacgtgcagtcaacctacaaacccaccgtctccaccgctaacattgccctgagctggtcctcggtggagcacagggggaacaagattctggtgtccgggcggtcagagagcatcatgaagctcgaggagcgcacgggcatcagctgggatctgggggtcgaagatgcctccgagagcaagttgctcacagtgagtgtaatggacctgagccagatgtacagcccggttttcgagtacctgtccggcgaccgccaggtggaagagtggcccaaggcaacttgcacaggcgactgccccgagcggtgcgggtgcacgagctcgacctgccttcataaagagtggccacacagccggaactggcgctgcaacccgacctggtgctggggcgtggggaccgggtgtacgtgctgcgggctggacgtcaaggacctgttcaccgactacatgttcgtgaagtggaaggtggagtacatcaagaccgaggcgatcgtctgcgtggagctcacctcgcaggagcgtcagtgcagcctgatcgaggccgggacgcgcttcaacctgggccccgtgaccatcaccctctccgaaccgcggaacatccaacaaaagctgccaccggagatcatcaccctgcacccccgcattgaggagggcttcttcgacctcatgcacgtccaaaaggtgctgagcgcatctactgtgtgcaaactgcagagctgtacccacggagtacccggggacctccaagtataccacatcggtaatctgctgaagggagacaaggtgaacgggcatctcatccacaagatcgagccgcacttcaatacctcctggatgagctgggacggctgcgacctggattactattgcaacatgggggactggccgtcctgcacttatacgggcgttactcagcacaatcacgccagcttcgtgaacctactcaacatagagaccgactacaccaaaaatttccactttcactccaagcgggtgacagcacacggggacactccccaactggacctgaaggcccgccccacctatggcgccggagagataacggtcctcgtggaggtggccgacatggagctgcacacgaagaagatcgagatcagcgggttgaagttcgcctccctcgcctgcaccggatgctatgcgtgcagctccagcatctcatgcaaggtccggatccacgtggacgagccggacgagctgaccgtgcacgtaaaaagcgacgaccccgatgtcgtggccgccagctccagcctgatggcgcgcaaactcgagttcgggaccgactccaccttcaaggcgttcagcgcaatgcccaagacgagcctgtgcttctacatcgtcgagagagagcactgcaagagctgctcagaggaggacaccaaaaagtgcgtgaacaccaagctggagcagccccagagcatcctaatcgaacataaggggacaatcatcgggaagcagaactccacttgcaccgcgaaagcctcttgctggctagagtctgtaaagagcttcttctacgggctaaagaacatgctctccggcatcttcgggaatgttttcatgggcatcttcttattcctcgcgcccttcatcctcctgatcctgttctttatgttcggatggcggattctgttctgtttcaagtgctgccgccggacccgcggccttttcaagtacagacatttgaaagacgacgaggagaccgggtacagaagaatcatcgagaagctcaacaacaagaaaggcaagaacaagctgctggacggcgaacggctcgctgacgggcggatcgccgaactcttcagcacgaagacccatattggctga

SEQ ID NO: 16927 - RNA, 2973 nt, synthetic construct
  misc_feature 1..2973: note = derived and/or modified CDS sequence (opt11) from CCHVF(10200)__U39455.2__IgE-leader_Gn-4aa-Gc
  source 1..2973: mol_type = other RNA
atggactggacctggatcctctttctggttgccgcagccacccgcgttcactccagcgaagaaccctcggacgactgcgttagtagaactcaactcctacggacagaaaccgcagagatccacggcgataactacggcggccccggcgacaagattactatctgcaacggcagcaccatcgtcgaccaacgactcggctcagaactaggctgctacaccattaaccgcgtccgcagcttcaaactatgcgagaacagcgcgaccgggaagaactgcgaaatcgactcagtacctgtcaaatgcagacaaggatactgcctgcgaatcacccaagaaggtcgcggacacgtcaagctatcccgcggatcagaagttgttctggacgcgtgcgacaccagttgcgaaatcatgataccaaaaggcaccggtgacattctcgtagactgcagcggcggccaacaacactttttaaaagacaacctcatcgacctcggatgcccaaaaatacctctcctcggtaaaatggctatctacatatgcaggatgtctaaccatcccaaaacaacgatggctttccttttctggttctcctttgggtacgtcataacctgcatactctgcaaagcaatcttctacctcctcatcatcgtagggacactaggacgccgattaaaacagtaccgcgagctaaaaccacaaacatgcacaatttgcgagacaacaccagtcaacgcaatcgatgctgaaatgcacgacctcaactgttcatataacatctgcccctactgcgcctcgcgtctaacctcagacggcctcgccagacacgtcatccaatgccccaagcgcaaggaaaaggtcgaagaaaccgaactatacttgaacctagaacgcatcccgtgggttgtcagaaaactgcttcaggtctcagaatctaccggagtagccctcaagcgctcatcctggctcattgtactgctcgtactctttaccgtgagcttaagcccagtccaatccgcccccatcggccgaaaaccactattcctcgattccacagccaaaggtatgaaaaacctcctcaattcgacctccctcgaaacctccctctcgatcgaagccccctggggcgccataaacgtccaatccacttacaaacctactgtgtctacagcaaatatcgccctatcctggtcttccgtagagcaccgcgggaacaaaatactcgtatctggccgctccgagagcatcatgaagctcgaagaacgcaccggaatctcctgggaccttggcgtagaggatgcgtcagaatcaaagctccttaccgtcagcgtcatggacctatcgcaaatgtactccccagtcttcgaatacctgagcggcgaccgccaggtggaagagtggcccaaagcaacctgcaccggggactgccccgaacggtgcggttgcacttcgtcaacatgccttcacaaagaatggccccacagccggaactggcgctgtaaccccacatggtgctggggcgtcggtaccggatgtacatgctgcggacttgatgtaaaggaccttttcaccgactatatgttcgttaagtggaaggttgaatacatcaaaacagaagcaatagtctgcgtcgagctcacatcccaagagcgtcaatgctccctaatagaagctggaacccgctttaacttaggtccggtcacaataacactatcagaacctcgcaatatccaacaaaagctccctcccgaaatcatcacccttcacccccgcatcgaagaaggattcttcgacctcatgcacgtccaaaaagtgctcagcgccagcacagtctgtaaactccaatcctgtacccacggcgtacccggagacctacaagtttatcacatagggaatctcctaaaaggggacaaagtcaatggccacctcatacacaaaatcgagccacacttcaacaccagctggatgtcctgggacgggtgcgatctagactactactgcaacatgggggactggccctcttgcacctacacgggagtcacacagcacaatcacgcctcattcgtaaaccttctaaacatcgaaacggactacactaaaaatttccacttccactcgaaaagggtcacagcacacggcgacacaccccagctcgacctcaaagcccgccccacctacggcgcaggagaaatcacagtactcgttgaagtagccgacatggagctacataccaagaaaatcgaaatctcaggactcaaatttgcctcactagcctgcacgggctgctacgcatgctcatcttccatctcctgcaaagtacgcatccacgtcgacgaaccagacgagctcaccgtccatgtcaaaagcgatgacccagacgtggtcgccgcttccagctctcttatggctcgaaaactagagttcggcacagactccaccttcaaggctttctcggccatgcccaaaacctcgctctgcttctacatcgttgagcgggagcactgtaaatcctgctccgaagaagataccaaaaagtgcgtcaacaccaaactcgagcaaccgcagtccattctcatcgaacacaaaggcacaatcatcggaaaacaaaacagcacatgcaccgccaaggcatcctgttggcttgaaagcgtgaagtccttcttctacggactcaaaaacatgctatccggcatcttcggcaacgtcttcatgggaatcttcctgtttctggccccctttatactcctaatactcttcttcatgttcggatggcgcatcctcttttgcttcaaatgttgcagacgaacacgcggcctcttcaaataccgccacctcaaagacgacgaagaaacgggctatcgcagaataatcgaaaaattgaacaacaagaaaggcaaaaacaaactcctggacggagaacgattagccgacggcaggatagccgaactattttcaaccaaaacgcacataggttaa

SEQ ID NO: 16928 - RNA, 1029 nt, synthetic construct
  misc_feature 1..1029: note = derived and/or modified CDS sequence (opt11) from CCHVF(10200)__U39455.2__IgE-leader_Gn
  source 1..1029: mol_type = other RNA
atggactggacctggatcctcttcctagttgccgccgctacccgcgtccactcctcagaggaaccctccgacgactgcgtctcccgcactcaactcttacgcaccgaaacagccgagatccacggcgacaactacgggggacccggcgacaaaatcaccatatgcaacggctccaccatcgtcgaccaacgcctcggctcagaactcggctgctacacgatcaaccgagtccgctctttcaaactctgtgaaaactcagcaaccggcaaaaactgtgaaatcgactccgtacccgtgaaatgcagacaaggatattgcctccgaatcacccaagaaggacgcggccacgtcaaactcagccgaggctcagaagtcgtcctcgacgcctgcgacacctcatgcgaaatcatgatccccaaaggaaccggcgacatcctcgtcgactgctccggcggccaacaacacttccttaaagacaacctcatagacctcggatgccccaaaatacctctactagggaaaatggccatctacatatgccgcatgtccaaccaccccaaaacaactatggccttccttttctggttctcgttcggctacgtcatcacatgcatcctctgcaaagccatcttttacctacttatcatcgtaggcaccctaggccgccgtctaaaacaataccgcgaactcaaaccccaaacctgcaccatctgcgaaaccacccccgtaaacgccatcgacgcagaaatgcacgacctaaactgctcctacaacatctgcccatactgcgcctcccgcctaacctccgacggactcgcccgccacgtcatccaatgccccaaacgcaaagaaaaagtagaagaaacagaactatacctaaacctagaacgcataccgtgggtcgtccgtaaactcctccaagtctcagaatccaccggcgtcgcactcaaacgatcaagctggctaatcgtcctcctcgtcctcttcaccgtctcactatcccccgtccaatccgcccccatcggctaa

SEQ ID NO: 16929 - RNA, 1989 nt, synthetic construct
  misc_feature 1..1989: note = derived and/or modified CDS sequence (opt11) from CCHVF(10200)__U39455.2__IgE-leader_Gc
  source 1..1989: mol_type = other RNA
atggactggacctggatcctcttcctcgtcgccgccgcaacacgcgttcacagcttcctcgacagcaccgccaagggcatgaaaaacctactcaactcgacctccctagagacatccctctccatcgaagccccctggggagccatcaacgtccaatccacctacaaaccaaccgtgtccacggccaacatagcgctaagctggtccagcgtcgagcaccgaggaaacaagatcctagtctcgggccgaagcgaatcaataatgaagctcgaggaacgcacgggaatctcatgggatctcggcgtcgaagacgcaagcgaatcaaaactccttacagtgagcgtcatggacctttcacaaatgtactcgcccgtattcgaataccttagcggagaccgccaagttgaagagtggcccaaagcgacctgcaccggcgactgccccgaacgttgtggctgtacatcgagcacatgcctacacaaagaatggccacattccagaaactggcgctgcaacccgacctggtgctggggcgtgggcacaggctgcacatgctgcggccttgacgtcaaagacctattcaccgactacatgttcgtcaaatggaaagtagaatacataaaaaccgaagcaatagtctgcgtcgaactaacctcccaagaacgacaatgctcactcatagaagctggaacccgcttcaacctcggacccgtaacgatcactctctccgaaccccgaaacatccagcaaaaactccctcccgaaatcataaccctacacccacgtatcgaagaaggcttcttcgacctaatgcacgtgcaaaaagtactcagcgcgtccaccgtttgcaaactccaatcttgcactcacggcgtacccggcgacctgcaagtctaccacatcggcaacctcctcaagggcgacaaagtaaatggtcacctgatccacaaaatcgagccccacttcaacacctcctggatgagctgggacggatgcgacctcgactactactgcaacatgggagactggccctcatgcacgtacaccggcgtcacccaacacaaccacgcctcattcgtaaacctgctgaacatcgaaaccgactataccaagaacttccacttccacagcaaaagagtcaccgcccacggcgacacaccccaattagacctcaaagcccgccccacctacggcgccggcgaaataaccgtcctcgtcgaagtcgcagacatggaactacacacaaagaaaatagaaatttccggcctgaaattcgcatcactcgcatgcacaggctgctacgcgtgctcaagctcaatatcctgtaaagtccgaatccacgtagatgaaccagacgagctcaccgtacacgtcaagtcagacgacccagacgtagtagcggcctcatcctccctcatggcacgaaaactagagttcggcacagactcaacattcaaagcattcagcgcaatgccaaaaacctccctttgcttctacatcgtcgaacgcgaacactgcaaaagctgcagcgaagaagacacaaagaaatgcgttaacaccaaacttgaacaaccccaaagcatcctgatagaacacaaaggcactatcatcggaaagcagaactcaacctgcactgccaaggccagctgctggctcgaaagcgtgaaatcattcttttacggactgaaaaacatgctaagcggcattttcggtaacgtattcatgggcatcttcctcttcctggccccgttcatcctcttaatactatttttcatgttcggctggagaatcctattctgtttcaaatgctgccgccgcacgcgcggcctttttaaatatcgccaccttaaggacgatgaagaaaccggctaccgccgaataatagaaaaactaaacaacaaaaagggcaaaaacaaactcctcgacggcgaacgccttgcagacggccgcatagccgaactcttcagcacaaaaacccacataggctga

SEQ ID NO: 16930 - RNA, 1666 nt, synthetic construct
  misc_feature 1..1666: note = mRNA product Design1 comprising derived and/or modified sequence from CCHFV(10200)__NC_005302.1/U88410.1__N (wt)
  source 1..1666: mol_type = other RNA
gggagaaagcttaccatggaaaacaagatcgaggtgaataacaaagatgagatgaacaggtggtttgaagagttcaaaaaaggaaatggacttgtggacaccttcacaaactcctattccttttgcgagagtgttcccaatttggacaggtttgtgtttcagatggccagtgccaccgatgatgcacagaaggactccatctacgcatctgctctggtggaggcaacaaagttttgtgcacctatatatgagtgcgcatgggttagctccactggcattgtaaaaaagggacttgaatggttcgagaaaaatgcaggaaccattaagtcctgggatgaaagttatactgagctaaaggtcgacgtcccgaaaatagagcagcttaccggttaccaacaagctgccttgaagtggagaaaagacataggtttccgtgtcaatgccaacacagcagctctgagcaacaaagtcctcgcagaatacaaagtccctggtgagattgtgatgtctgtcaaagagatgctgtcagacatgattaggagaaggaacctgattctaaacaggggtggtgatgagaacccacgtggcccagtgagccatgagcatgtagactggtgcagggagtttgtcaaaggcaaatacatcatggccttcaacccaccatggggggacatcaacaagtcaggccgttcaggaatagcacttgttgcaacaggccttgctaagcttgcagagactgaaggaaagggaatatttgatgaagccaaaaagactgtggaggccctcaacgggtatctggacaagcataaggacgaagttgatagagcaagcgccgacagcatgataacaaaccttcttaagcatattgccaaggcacaggagctctataaaaattcatctgcacttcgtgcacaaagcgcacagattgacactgctttcagctcatactattggctttacaaggctggcgtgactcctgaaaccttcccgacggtgtcacagttcctctttgagctagggaaacagccaagaggtaccaagaaaatgaagaaggctcttctgagcaccccaatgaagtgggggaagaagctttatgagctctttgccgatgattctttccagcagaacaggatttacatgcatcctgccgtgcttacagctggtagaatcagtgaaatgggagtctgctttgggacaatccctgtggccaatcctgatgatgctgcccaaggatctggacacactaagtctattctcaacctccgtaccaacactgagaccaataatccgtgtgccaaaaccatcgtcaagctatttgaagttcaaaaaacagggttcaacattcaggacatggacatagtggcctctgagcacttgctacaccaatcccttgttggcaagcaatccccattccagaacgcctacaacgtcaagggcaatgccaccagtgctaacatcatttaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16931 - RNA, 1666 nt, synthetic construct
  misc_feature 1..1666: note = mRNA product Design1 comprising derived and/or modified sequence from CCHFV(10200)__NC_005302.1/U88410.1__N (wt)
  source 1..1666: mol_type = other RNA
gggagaaagcttaccatggaaaacaagatcgaggtgaataacaaagatgagatgaacaggtggtttgaagagttcaaaaaaggaaatggacttgtggacaccttcacaaactcctattccttttgcgagagtgttcccaatttggacaggtttgtgtttcagatggccagtgccaccgatgatgcacagaaggactccatctacgcatctgctctggtggaggcaacaaagttttgtgcacctatatatgagtgcgcatgggttagctccactggcattgtaaaaaagggacttgaatggttcgagaaaaatgcaggaaccattaagtcctgggatgaaagttatactgagctaaaggtcgacgtcccgaaaatagagcagcttaccggttaccaacaagctgccttgaagtggagaaaagacataggtttccgtgtcaatgccaacacagcagctctgagcaacaaagtcctcgcagaatacaaagtccctggtgagattgtgatgtctgtcaaagagatgctgtcagacatgattaggagaaggaacctgattctaaacaggggtggtgatgagaacccacgtggcccagtgagccatgagcatgtagactggtgcagggagtttgtcaaaggcaaatacatcatggccttcaacccaccatggggggacatcaacaagtcaggccgttcaggaatagcacttgttgcaacaggccttgctaagctggcagagactgaaggaaagggaatatttgatgaagccaaaaagactgtggaggccctcaacgggtatctggacaagcataaggacgaagttgatagagcaagcgccgacagcatgataacaaaccttcttaagcatattgccaaggcacaggagctctataaaaattcatctgcacttcgtgcacaaagcgcacagattgacactgctttcagctcatactattggctttacaaggctggcgtgactcctgaaaccttcccgacggtgtcacagttcctctttgagctagggaaacagccaagaggtaccaagaaaatgaagaaggctctgctgagcaccccaatgaagtgggggaagaagctgtatgagctctttgccgatgattctttccagcagaacaggatttacatgcatcctgccgtgcttacagctggtagaatcagtgaaatgggagtctgctttgggacaatccctgtggccaatcctgatgatgctgcccaaggatctggacacactaagtctattctcaacctccgtaccaacactgagaccaataatccgtgtgccaaaaccatcgtcaagctatttgaagttcaaaaaacagggttcaacattcaggacatggacatagtggcctctgagcacttgctacaccaatcccttgttggcaagcaatccccattccagaacgcctacaacgtcaagggcaatgccaccagtgctaacatcatttaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16932 - RNA, 1666 nt, synthetic construct
  misc_feature 1..1666: note = mRNA product Design1 comprising derived and/or modified sequence from CCHFV(Turkey-Kelkit06)__GQ337053.1__N (wt)
  source 1..1666: mol_type = other RNA
gggagaaagcttaccatggaaaacaagatcgaggtgaacagcaaggatgagatgaacaaatggtttgaggagtttaaaaagggaaatggacttatggacactttcacaaactcctactccttttgtgagaatgtaccaaatctggataagtttgtgttccagatggccagcgccacagatgatgcacagaaggactccatctatgcatcggctctagtggaagcaaccaagttctgtgcacccatatatgaatgtgcttgggtcagctctactggcattgtgaagaaggggcttgagtggttcgagaaggattcaggaactatcaaatcatgggatgagaactatgctgagctgaaggttgatgttcccaaaatagaacaacttgccaattaccaacaggctgctcttaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggctttcaatccaccttggggggacatcaacaaatcaggtcgttcgggaatagcacttgttgcaacaggccttgccaagcttgcagagaccgaggggaaaggagtttttgacgaagctaagaagaccgtggaggctctcaatgggtatttggacaagcacagggacgaagtcgacaaagcaagtgctgacagcatgataacaaacctccctaagcacattgccaaagcacaagagctttataaaaattcatctgctcttcgtgcacaaggtgcacagattgacacccctttcagctcgttttactggctctacaaggccggtgtgactccagagaccttcccaaccatctcacagttcctttttgaactgggggagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatccattgttggcaagcaatctccattccaaaatgcctacaacgtcaagggcaatgccaccagtgccaacatcatctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16933 - RNA, 1666 nt, synthetic construct
  misc_feature 1..1666: note = mRNA product Design1 comprising derived and/or modified sequence from CCHFV(Turkey-Kelkit06)__GQ337053.1__N (wt)
  source 1..1666: mol_type = other RNA
gggagaaagcttaccatggaaaacaagatcgaggtgaacagcaaggatgagatgaacaaatggtttgaggagtttaaaaagggaaatggacttatggacactttcacaaactcctactccttttgtgagaatgtaccaaatctggataagtttgtgttccagatggccagcgccacagatgatgcacagaaggactccatctatgcatcggctctagtggaagcaaccaagttctgtgcacccatatatgaatgtgcttgggtcagctctactggcattgtgaagaaggggcttgagtggttcgagaaggattcaggaactatcaaatcatgggatgagaactatgctgagctgaaggttgatgttcccaaaatagaacaacttgccaattaccaacaggctgctcttaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggctttcaatccaccttggggggacatcaacaaatcaggtcgttcgggaatagcacttgttgcaacaggccttgccaagctggcagagaccgaggggaaaggagtttttgacgaagctaagaagaccgtggaggctctcaatgggtatttggacaagcacagggacgaagtcgacaaagcaagtgctgacagcatgataacaaacctccctaagcacattgccaaagcacaagagctttataaaaattcatctgctctgcgtgcacaaggtgcacagattgacacccctttcagctcgttttactggctctacaaggccggtgtgactccagagaccttcccaaccatctcacagttcctttttgaactgggggagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatccattgttggcaagcaatctccattccaaaatgcctacaacgtcaagggcaatgccaccagtgccaacatcatctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16934 - RNA, 5272 nt, synthetic construct
  misc_feature 1..5272: note = mRNA product Design1 comprising derived and/or modified sequence from CCHFV(10200)__U39455.2__GP (wt)
  source 1..5272: mol_type = other RNA
gggagaaagcttaccatgcatatatcattaatgtatgcaatcctttgcctacagctgtgtggtctgggagagactcatggatcacacaatgaaactagacacaataaaacagacaccatgacaacacacggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctttagaagattgctttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16935 - RNA, 5272 nt, synthetic construct
  misc_feature 1..5272: note = mRNA product Design1 comprising derived and/or modified sequence from CCHFV(10200)__U39455.2__GP (wt)
  source 1..5272: mol_type = other RNA
gggagaaagcttaccatgcatatatcattaatgtatgcaatcctttgcctacagctgtgtggtctgggagagactcatggatcacacaatgaaactagacacaataaaacagacaccatgacaacacacggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggagatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagagttctttataactggtgagggccattttaatgaagttttacaatttagaacgccaggcacgttgagcaccacagagtcaacccctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctttagaagattgctttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16936 - RNA, 5272 nt, synthetic construct
  misc_feature 1..5272: note = mRNA product Design1 comprising derived and/or modified sequence from CCHFV(IbAr10200)__AF467768.2__GP (wt)
  source 1..5272: mol_type = other RNA
gggagaaagcttaccatgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16937 - RNA, 5272 nt, synthetic construct
  misc_feature 1..5272: note = mRNA product Design1 comprising derived and/or modified sequence from CCHFV(IbAr10200)__AF467768.2__GP (wt)
  source 1..5272: mol_type = other RNA
gggagaaagcttaccatgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggagatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagagttctttataactggtgagggccattttaatgaagttttacaatttagaacgccaggcacgttgagcaccacagagtcaacccctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctggcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16938 - RNA, 5284 nt, synthetic construct
  misc_feature 1..5284: note = mRNA product Design1 comprising derived and/or modified sequence from CCHFV(Turkey-Kelkit06)__GQ337054.1__GP (wt)
  source 1..5284: mol_type = other RNA
gggagaaagcttaccatgcccaccaacattatgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagcttctgcacctcaccttagaacaggacaccgaaggcctgctagaatggtgtaagggaaaccttgggtcaaactgtgatgatgacttctttcaaaagagaatagaagaattcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgaaagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16939 - RNA, 5284 nt, synthetic construct
  misc_feature 1..5284: note = mRNA product Design1 comprising derived and/or modified sequence from CCHFV(Turkey-Kelkit06)__GQ337054.1__GP (wt)
  source 1..5284: mol_type = other RNA
gggagaaagcttaccatgcccaccaacattatgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagctgctgcacctcaccttagaacaggacaccgaaggcctgctagaatggtgtaagggaaaccttgggtcaaactgtgatgatgacttctttcaaaagagaatagaagagttcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagaaccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaatcccttggattgtcagaaagctattgcaggtctcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgagagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagggccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaaccagcttggaaaccagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgttgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagctgcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggagggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagctggaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16940 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (wt)
  source 1..3796: mol_type = other RNA
gggagaaagcttaccatgcatatatcattaatgtatgcaatcctttgcctacagctgtgtggtctgggagagactcatggatcacacaatgaaacttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16941 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (wt)
  source 1..3796: mol_type = other RNA
gggagaaagcttaccatgcatatatcattaatgtatgcaatcctttgcctacagctgtgtggtctgggagagactcatggatcacacaatgaaacttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16942 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (wt)
  source 1..3769: mol_type = other RNA
gggagaaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16943 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (wt)
  source 1..3769: mol_type = other RNA
gggagaaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16944 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (wt)
  source 1..3190: mol_type = other RNA
gggagaaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16945 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (wt)
  source 1..3190: mol_type = other RNA
gggagaaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16946 - RNA, 1246 nt, synthetic construct
  misc_feature 1..1246: note = mRNA product Design1 comprising derived and/or modified sequence from CCHVF(10200)__U39455.2__IgE-leader_Gn (wt)
  source 1..1246: mol_type = other RNA
gggagaaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggttagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16947 - RNA, 1246 nt, synthetic construct
  misc_feature 1..1246: note = mRNA product Design1 comprising derived and/or modified sequence from CCHVF(10200)__U39455.2__IgE-leader_Gn (wt)
  source 1..1246: mol_type = other RNA
gggagaaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggttagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16948 - RNA, 2206 nt, synthetic construct
  misc_feature 1..2206: note = mRNA product Design1 comprising derived and/or modified sequence from CCHVF(10200)__U39455.2__IgE-leader_Gc (wt)
  source 1..2206: mol_type = other RNA
gggagaaagcttaccatggactggacctggatcctgttcctcgtggccgccgcgacccgcgtccacagcttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16949 - RNA, 2206 nt, synthetic construct
  misc_feature 1..2206: note = mRNA product Design1 comprising derived and/or modified sequence from CCHVF(10200)__U39455.2__IgE-leader_Gc (wt)
  source 1..2206: mol_type = other RNA
gggagaaagcttaccatggactggacctggatcctgttcctcgtggccgccgcgacccgcgtccacagcttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16950 - RNA, 1666 nt, synthetic construct
  misc_feature 1..1666: note = mRNA product Design1 comprising derived and/or modified sequence from CCHFV(10200)__NC_005302.1/U88410.1__N (opt4)
  source 1..1666: mol_type = other RNA
gggagaaagcttaccatggagaacaagatcgaggtgaacaacaaggacgagatgaacagatggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctgaccggctaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagccacgagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcatcttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagagcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgaggtgcagaagaccggcttcaacatccaggacatggacatcgtggccagcgagcatctgctgcaccagagcctggtgggcaagcagagccccttccagaacgcctacaacgtgaagggcaacgccaccagcgccaacatcatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16951 - RNA, 1666 nt, synthetic construct
  misc_feature 1..1666: note = mRNA product Design1 comprising derived and/or modified sequence from CCHFV(Turkey-Kelkit06)__GQ337053.1__N (opt4)
  source 1..1666: mol_type = other RNA
gggagaaagcttaccatggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaaggacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgcccaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcgagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccaggagaccggcttcaacatccaggacatggacatcgtggccagcgagcatctgctgcaccagagcatcgtgggcaagcagagccccttccagaacgcctacaacgtgaagggcaacgccaccagcgccaacatcatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16952 - RNA, 5272 nt, synthetic construct
  misc_feature 1..5272: note = mRNA product Design1 comprising derived and/or modified sequence from CCHFV(10200)__U39455.2__GP (opt4)
  source 1..5272: mol_type = other RNA
gggagaaagcttaccatgcacatcagcctgatgtacgccatcctgtgcctgcagctgtgcggcctgggcgagacccacggcagccacaacgagaccagacacaacaagaccgacaccatgaccacccacggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcttcagaagactgctgagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16953 - RNA, 5272 nt, synthetic construct
  misc_feature 1..5272: note = mRNA product Design1 comprising derived and/or modified sequence from CCHFV(IbAr10200)__AF467768.2__GP (opt4)
  source 1..5272: mol_type = other RNA
gggagaaagcttaccatgcacatcagcctgatgtacgccatcctgtgcctgcagctgtgcggcctgggcgagacccacggcagccacaacgagaccagacacaacaagaccgacaccatgaccacccccggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaagggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16954 - RNA, 5284 nt, synthetic construct
  misc_feature 1..5284: note = mRNA product Design1 comprising derived and/or modified sequence from CCHFV(Turkey-Kelkit06)__GQ337054.1__GP (opt4)
  source 1..5284: mol_type = other RNA
gggagaaagcttaccatgcccaccaacatcatgcacacccccctggtgtgcttcatcctgtacctgcagctgctgtgcctgggcggcgcccacggccagctgaacgccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcccccccaacaccacccagggcctgagcagccccgagaccaccagcgagagacccgccaccaccagcatcagcaccagcagcaccgacagcaccaaccccaccacccagatgaccgacaacacccccacccccaccgtgagcaccagccccagcagcagccccagcacccccagcaccccccagggcatccaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagatcaccaaccacagaacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggagcaggacaccgagggcctgctggagtggtgcaagggcaacctgggcagcaactgcgacgacgacttcttccagaagagaatcgaggagttcttcatgaccggcgagtgctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagtttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgtatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtcagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgagagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagggccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggagccacagcagaaactggagatgcaaccccacctggtgctggggcgtgggcaccggctgcacctgttgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtctaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagtagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgtaccgccaaggccagctgctggctggagagcgtgaagagtttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16955 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (opt4)
  source 1..3796: mol_type = other RNA
gggagaaagcttaccatgcacatcagcctgatgtacgccatcctgtgcctgcagctgtgcggcctgggcgagacccacggcagccacaacgagaccagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16956 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (opt4)
  source 1..3769: mol_type = other RNA
gggagaaagcttaccatggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16957 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (opt4)
  source 1..3190: mol_type = other RNA
gggagaaagcttaccatggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggcagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16958 - RNA, 1246 nt, synthetic construct
  misc_feature 1..1246: note = mRNA product Design1 comprising derived and/or modified sequence from CCHVF(10200)__U39455.2__IgE-leader_Gn (opt4)
  source 1..1246: mol_type = other RNA
gggagaaagcttaccatggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16959 - RNA, 2206 nt, synthetic construct
  misc_feature 1..2206: note = mRNA product Design1 comprising derived and/or modified sequence from CCHVF(10200)__U39455.2__IgE-leader_Gc (opt4)
  source 1..2206: mol_type = other RNA
gggagaaagcttaccatggactggacctggatcctgttcctggtggccgccgccaccagagtgcacagcttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16960 - RNA, 1666 nt, synthetic construct
  misc_feature 1..1666: note = mRNA product Design1 comprising derived and/or modified sequence from CCHFV(10200)__NC_005302.1/U88410.1__N (opt3)
  source 1..1666: mol_type = other RNA
gggagaaagcttaccatggagaacaagatcgaagtgaataacaaagacgagatgaatagatggttcgaagagtttaagaaaggcaacgggctggtcgataccttcacaaatagctactccttttgcgaatctgttcccaacctcgacaggttcgtgtttcagatggcctcagctactgatgacgcacaaaaggatagtatttatgccagcgcgcttgtagaggctacgaaattctgtgcccctatatacgagtgcgcatgggtgtcctctaccggaatcgtcaagaagggtctggaatggtttgagaaaaatgccggcacaattaagtcgtgggacgaatcatatactgagttgaaagtggatgttccaaagatcgagcagttaaccgggtaccagcaggctgcactgaaatggcggaaggacattggattccgcgtgaacgccaatacagctgccctaagcaacaaggtcctcgcggaatataaagtgccgggcgagatcgtaatgagtgttaaggaaatgctgtccgatatgatacgacgtagaaatcttatcctgaacaggggtggggacgagaatccccggggacctgtgtctcacgaacatgtcgattggtgtcgcgagtttgtgaaaggcaagtacattatggcattcaacccaccctggggcgacatcaataaaagcgggagatccggaattgccttggtggctaccggtctcgccaagctggcagagactgaaggcaaagggatctttgatgaggctaagaagacagtcgaagccctgaacggatatctcgacaaacacaaggacgaggttgatagggcgtcagccgacagtatgataaccaacttactgaaacatattgcaaaggctcaagaactttacaaaaatagctctgccttgcgggctcagtccgcccagatcgatacggcattctcaagctactattggctgtacaaggccggcgtgactcctgagacctttccaacagtaagtcagttcctattcgagctcggtaagcaaccccgcgggactaaaaagatgaaaaaggctctgctttctacccctatgaaatggggaaagaagctgtatgaattgtttgcggacgattccttccagcagaaccgaatttacatgcacccagcagtgctcacagccggcagaatcagcgagatgggcgtctgctttgggaccatcccggtggctaatcccgacgatgccgcacagggatcgggtcatacgaaatctattctgaacttaaggactaatacagaaaccaacaatccttgtgccaagactatagttaaactgttcgaggtgcaaaagacaggctttaacatccaggacatggatattgtcgcttccgaacacctccttcaccagtcactggtggggaaacaaagtccattccagaatgcctataacgtaaagggaaatgcaaccagcgcgaacatcatatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16961 - RNA, 1666 nt, synthetic construct
  misc_feature 1..1666: note = mRNA product Design1 comprising derived and/or modified sequence from CCHFV(Turkey-Kelkit06)__GQ337053.1__N (opt3)
  source 1..1666: mol_type = other RNA
gggagaaagcttaccatggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaagactcgggcacaattaagtcatgggatgaaaattatgccgagttgaaagtcgacgtgccaaagatcgagcagttagctaactaccagcaggcagccctgaagtggagaaaagatattgggttcagggttaatgctaacactgccgcgctaagcaataaggtgctcgcagaatataaagtcccgggagagatcgtgatgagtgtaaaggaaatgctgtccgacatgatacggcgccgaaaccttatcctgaatcgtggcggtgatgagaaccccagagggcctgtttctagggaacacgtggagtggtgtcgggagtttgtcaaaggaaagtacattatggccttcaatccaccctggggcgacatcaacaaaagcggccgctccgggattgctttggtggccaccggactcgcaaagctggctgaaacagagggtaagggcgtgtttgatgaagccaaaaagaccgtcgaggcgctgaacgggtatctcgacaaacatagagacgaagttgataaggcctcagcagacagtatgatcactaatttacctaaacacatagctaaggcccaagagctgtacaagaacagctctgctcttagggcccagggagcacagattgatacaccattctcctcattttactggttgtataaagccggcgtgacccccgagacgttccctactatcagccagttcctgtttgaactaggtgagcaaccacgggggaccaagaaaatgaagaaagctctcctgagtacaccgatgaagtggggaaagaaactttacgaactgttcgcggacgattcttttcagcagaatcgcatttatatgcatcccgcagtattgactgccggccgaatctccgagatgggcgtgtgcttcgggaccatccctgtcgctaacccagacgatgccgcacagggaagcggtcacacaaagtcgattctcaatctgagaacctctacggaaactaacaatccctgtgccaaaacaatagtgaagttatttgagatccaagagaccggcttcaacattcaggacatggatatcgttgcttccgaacatctgctccaccagtcaatagtggggaaacaaagtccttttcagaatgcctacaacgtcaagggaaatgcaactagcgcgaacattatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16962 - RNA, 5272 nt, synthetic construct
  misc_feature 1..5272: note = mRNA product Design1 comprising derived and/or modified sequence from CCHFV(10200)__U39455.2__GP (opt3)
  source 1..5272: mol_type = other RNA
gggagaaagcttaccatgcacatcagcctgatgtacgccattctctgccttcagctgtgtggcttgggggagacccatggatcccacaacgaaacaagacataataagactgacacgatgaccacacacggtgataacccctcttcagagcctccagtgagtactgctttaagcataaccctggacccgtccacagtcacccccactactcctgcatctggcctagaagggtcgggagaggtttatacctcaccacccatcacgactggcagcctccctctgagtgaaaccacaccagagcttcccgtgactaccggtacagataccctgtccgccggggacgtagatccttctacgcagactgcgggaggcacaagcgctccaaccgtgaggacttccttgcccaattcacccagtacacctagcaccccacaggacacgcatcaccccgtccggaacctcctgtctgtgacctcccctggcccagatgagacatcaactcccagcgggaccggaaaagaaagttctgccacatccagcccgcaccctgtttcgaatcgcccgccaactcctcccgcaaccgcccagggtccaacagagaacgactctcataatgctaccgaacaccccgagtccctgactcagtcagcaacgcctggcctcatgacaagtccaacccaaattgtgcatccgcagagcgccactcccatcaccgtccaggatacacacccttccccaaccaaccgatctaagcgtaatttaaaaatggagattatcctgactcttagccaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacccggcaccctgtcaacaactgagagtacccctgctggcctcccaacggccgaacccttcaagtcctactttgcgaaagggttccttagcatcgactctggatattactcagcaaagtgctatagtggtaccagcaactccggcctgcagttgattaatatcacaagacattctactaggatagtagacaccccggggcctaaaattacaaacctaaagactatcaattgtattaacctgaaggcctcgatctttaaagagcaccgggaagttgagatcaacgtgctcctgccacaagtcgctgtgaatcttagcaactgccatgtggtcattaagtcccacgtttgtgattactcactggacatagatggagccgtgcgcttgccccatatctaccacgagggcgtattcattcctggtacctataaaatcgtgatagacaagaaaaataagctcaacgatcgatgcacgctgtttacagactgtgtcattaaagggagagaagtgaggaagggccagagtgttttacggcagtacaagaccgagatccgtatcggaaaagcatctactggcttccgcagactgctaagcgaggaaccctccgatgactgcgtgtcaaggacacaactcctgcggaccgaaactgctgagattcacggggataattatggaggtccaggcgacaagatcaccatttgtaacgggagcacaatagtcgatcagcgacttggatctgagttgggctgctacacgatcaatcgcgtgagatcctttaaactgtgcgaaaacagtgccaccggtaagaattgtgagattgacagcgtacctgttaaatgcaggcaggggtattgtctccggatcactcaggaaggccgcggacatgtgaagctgtctagaggctccgaggtcgtgcttgacgcgtgcgatacatcatgtgagatcatgattcccaaggggaccggagacatactggtcgattgcagtggtggccaacagcacttcttgaaagacaacctcatcgatctggggtgtccaaagattccgttactgggaaaaatggccatctacatttgcaggatgagcaatcatcctaagacaactatggcattcctattttggttctcgtttggctatgtgatcacctgtatactctgcaaagctatcttctacctgcttattatcgttggtacgttggggcgtcggctgaagcagtaccgagaactcaagccccagacatgtaccatttgcgagactaccccagtgaacgccatcgacgctgaaatgcacgatctgaattgctcctataacatatgtccctactgcgcctctagattaacaagcgacggcctggcaaggcacgtaattcaatgtcctaaacgcaaggagaaagtcgaagagactgagctttatttgaatctcgaacggatcccatgggtggttagaaagctgctacaggtgtcagagagtaccggagtcgccctgaaaaggtcctcttggctcattgtgctgcttgtattgtttacagtgagcctgtcccccgttcagtcagctcctatcggccaggggaagacgatagaagcgtaccgcgcacgagagggatataccagcatctgcttattcgtcctcggcagtattctgtttatcgtgtcttgtcttatgaagggtctggtggattccgtcgggaacagcttctttccgggattgtcgatttgcaaaacttgttcaatctctagtataaacggcttcgaaattgagtcccataagtgctactgtagcctcttttgctgtccatattgccggcactgctctacagacaaagagatccataagctgcacctaagcatctgtaaaaagcgtaaaaccggttccaatgttatgctggccgtgtgcaagctcatgtgtttcagagctactatggaagtgtcaaacagggccctgtttattcgcagtatcattaatacaaccttcgtactttgcatattgatcctggcagtctgtgtggttagcacgtctgccgtggagatggaaaacttacccgctggcacttgggagcgggaagaggatctcaccaatttctgccatcaagagtgtcaggtcacagaaaccgagtgcctgtgtccttacgaagcccttgtgctgagaaagccactatttctcgactccactgcaaaagggatgaagaacctgctcaattcaacaagtctggagaccagcttatccattgaggcgccctggggagctatcaacgttcagtctacatacaaacctactgtgtcgaccgccaatattgcactcagctggtcatccgtagaacacaggggcaacaagatcctggtcagtgggcgatctgagagcataatgaaacttgaggaacgcacgggaatctcctgggatctgggcgtggaagacgcctcagagtctaagttgctcacagtgagcgtcatggacctgagtcagatgtattccccggttttcgagtacctaagcggtgatcggcaagtggaagagtggcccaaggctacctgcactggggactgtccagaaagatgcggatgcacctcttcaacatgtctgcacaaagagtggcctcattccaggaattggcgttgcaaccccacttggtgttggggcgtaggtaccggctgcacgtgttgcgggcttgatgtgaaggacctctttacagattatatgttcgtcaaatggaaggtggaatacattaaaaccgaggccatcgtttgtgtggagctgacaagtcaggaacgccagtgcagcttgattgaggcaggaacacggtttaatctgggcccagtcaccatcactttatcggaacctagaaacatacaacagaagttgcccccagagattatcacactgcacccgaggatcgaagaggggttctttgaccttatgcatgtgcagaaggttctgtctgcttccaccgtgtgtaaattgcagagctgcacgcacggagtccctggcgatctccaagtatatcatattggtaatctgctaaagggggacaaagtgaacggacacctgatacacaagatcgagccccatttcaacacttcatggatgagttgggatggctgtgaccttgattactattgcaatatgggtgactggccatcttgcacctacacaggcgttacccagcacaaccatgcctcctttgtgaatctcctgaacattgaaacagattacactaaaaatttccactttcacagcaagcgagtcaccgcgcatggggacacgccccagttggacttaaaggcccggcctacatatggagctggcgagatcactgtgctggtagaagtggcagatatggagctccacaccaaaaagattgagatctcagggctgaaattcgccagtcttgcttgtacaggatgctacgcctgtagctcctctataagctgcaaggtccgcatccatgttgacgaaccagatgagctgaccgtgcacgtgaaatccgacgatcccgacgtcgtggcagcgtcatctagtttgatggccagaaagctagaatttggcactgattcgaccttcaaggctttcagcgccatgcctaaaacatccctgtgtttttatattgttgagagggaacattgcaagtcttgttcagaggaggacacgaaaaagtgcgtaaacactaaactcgaacagccgcaaagcatcctgattgagcacaagggtaccatcatagggaaacaaaattccacatgtaccgcaaaggctagttgctggcttgaatctgtcaagagcttcttttacggactgaaaaacatgttatcaggcattttcggcaatgtgtttatggggatcttcctctttttggccccattcatcctgctcattctgtttttcatgtttggatggcggatccttttctgtttcaagtgctgccgaagaactcgcggtctgtttaaatataggcacttgaaggatgacgaggaaacaggctaccgtcggataattgagaaactaaacaataagaaggggaaaaacaagctgctcgatggagagagattagcagacggcaggatcgccgaactgttctccaccaaaacgcatattggttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16963 - RNA, 5272 nt, synthetic construct
  misc_feature 1..5272: note = mRNA product Design1 comprising derived and/or modified sequence from CCHFV(IbAr10200)__AF467768.2__GP (opt3)
  source 1..5272: mol_type = other RNA
gggagaaagcttaccatgcacatcagcctgatgtacgccattctctgccttcagctgtgtggcttgggggagacccatggatcccacaacgaaacaagacataataagactgacacgatgaccacacccggtgataacccttcttcagagccaccggtgagtactgctttaagcataaccctggacccctccacagtcacccctactacaccagcatctggcctagaagggtcgggagaggtttatacctcaccccctatcacgactggcagcctcccactgagtgaaaccacacccgagcttcctgtgactaccggtacagataccctgtccgccggggacgtagatccatctacgcagactgcgggaggcacaagcgctccgaccgtgaggacttccttgcccaattcacctagtacaccaagcacaccccaggacacgcaccatcctgtccggaacctcctgtctgtgacctccccaggccccgatgagacatcaactccgagcgggaccggaaaagaaagttctgccacatccagccctcaccccgtttcgaatcgcccacctactcccccagcaaccgcccagggtcccacagagaacgactctcacaatgctaccgaacatcctgagtccctgactcagtcagcaacgccaggcctcatgacaagtccgacccaaattgtgcacccccagagcgccactcctatcaccgtccaggatacacatccatcccccaccaaccgatctaagcgtaatttaaaaatggagattatcctgactcttagccaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacctggcaccctgtcaacaactgagagtaccccagctggcctccccacggccgaaccgttcaagtcctactttgcgaaagggttccttagcatcgactctggatattactcagcaaagtgctatagtggtaccagcaactccggcctgcagttgattaatatcacaagacactctactaggatagtagacacccctgggccaaaaattacaaacctaaagactatcaattgtattaacctgaaggcctcgatctttaaagagcatcgggaagttgagatcaacgtgctcctgccccaagtcgctgtgaatcttagcaactgccacgtggtcattaagtcccatgtttgtgattactcactggacatagatggagccgtgcgcttgcctcacatctaccatgagggcgtattcattcccggtacctataaaatcgtgatagacaagaaaaataagctcaacgatcgatgcacgctgtttacagactgtgtcattaaagggagagaagtgaggaagggccagagtgttttacggcagtacaagaccgagatccgtatcggaaaagcatctactggcagccgcagactgctatccgaggaaccatcagatgactgcattagcaggacacaactcctgcggaccgaaactgctgagatccacggggataattatggaggtcctggcgacaagattaccatatgtaacgggtctacaatcgtggatcagcgacttggatccgagttgggctgctacacgattaatcgcgtcagaagtttcaaactgtgcgaaaacagcgccaccggtaagaattgtgagatcgactctgtgcccgtaaaatgcaggcaggggtattgtctccggatcactcaggaaggccgcggacacgttaagctgtccagaggctcagaggtggtccttgacgcgtgcgatacaagttgtgagattatgataccaaaggggaccggagacatcctggtggattgcagcggtggccaacagcattttcttaaagacaacctcattgatctggggtgtccgaagatccctttactgggaaaaatggccatttacatctgcaggatgtcgaatcaccccaagacaactatggcattcctattctggttttccttcggctatgtcataacctgtatcctctgcaaagctatcttttacctgcttattattgtgggtacgttggggaagcgtctgaagcagtaccgggaactcaaaccacagacatgtaccatctgcgagactacccccgttaacgccatagacgctgaaatgcatgatctgaattgctcttataacatttgtccttactgcgccagccgattaacatcagacggcctggcaagacacgtgatccaatgtccaaagaggaaagagaaggtagaagagactgagctttatttgaatctcgaacgcattccctgggtcgtgcggaaactgctacaggttagtgagtccaccggagtggccctgaagagatctagctggctcatcgtcctgcttgtgttgttcacagtatccctgtcacctgtgcagagcgctccgataggccaggggaagacgatcgaagcgtacagggcacgcgagggatataccagtatttgcttatttgttctcggctctatcctgttcattgtctcctgtcttatgaaaggtctggtggatagcgtggggaactcgtttttcccaggattgtcaatctgcaagacttgttctataagttccattaacggctttgaaatcgagagccacaaatgctactgttctctcttctgctgtccctattgccgacattgcagcacagacaaggagatccacaaactgcatctatccatttgtaagaaacggaagaagggttcaaatgtcatgctggccgtttgcaaactcatgtgttttcgtgctaccatggaagtgagtaacagagccctgttcatcaggagcattataaatactacatttgtgctttgcatcttgattctggcagtatgtgtcgtgtctacctccgccgttgagatggaaaacttacctgctggcacgtgggagcgcgaagaggatctcactaatttctgccaccaagagtgtcaggtgaccgaaacagagtgcctgtgtccatacgaagcccttgtcctgcggaagcccctattcctcgactcaaccgcaaaagggatgaagaacctgttgaatagtactagcctggagacatccttatctatcgaggcgccttggggagctattaacgtgcagtcgacctacaaaccgacagttagcactgccaatatcgcactctcatggtccagtgtggaacatagaggcaacaagatactggtatctgggaggagcgagtccatcatgaaacttgaggaacgaaccggaatttcatgggatctgggcgtcgaagacgcctctgagagcaaattgctcacggtgagtgtgatggacctgtcccagatgtatagccccgtctttgagtacctatctggtgatcgccaagttggggaatggccaaaggctacatgcaccggagactgtcctgagcggtgcggctgcacttcatccacctgtctgcacaaagaatggccccacagtagaaattggaggtgcaacccaacatggtgttggggtgtgggcactgggtgcacctgttgcggacttgatgtaaaggacctcttcacggattatatgtttgtgaaatggaaggtcgagtacatcaagacagaagccattgtgtgtgttgagctgaccagccaggagcgtcagtgctcgttgatcgaagcaggcactcgcttcaatctggggcctgtgacaataaccttatctgagccccggaacattcaacagaaactcccaccggaaatcatcactctgcatcctagaattgaggaaggatttttcgaccttatgcacgtccagaaggtgctgtccgctagcacagtttgtaaattgcagtcatgcacccatggcgtgcccggtgatctccaagtctatcacatagggaatctgctaaagggagacaaagtaaacggccatctgatccacaagattgagccacactttaacacgagttggatgtcttgggatggttgtgaccttgattactattgcaatatgggcgactggccctcctgcacttacaccggggtgacacagcataaccacgccagcttcgttaatctcctgaacatcgagaccgattacacaaagaattttcatttccactcaaaaagggtgactgcgcacggagacacccctcagttggacttaaaggcccgaccaacgtatggcgctggggaaattacagtcctggtggaggtagcagatatggaactccatactaaaaagatcgagataagtggactgaaatttgccagccttgcttgtaccggctgctacgcctgttcctctggtatcagctgcaaggtgcggattcacgtcgacgagcccgatgaactgacagttcatgtgaaatccgacgatcctgacgtggtcgcagcgtcatctagtttgatggcccgcaagctagagttcgggaccgattcgacttttaaggctttcagcgccatgccgaaaacctccctgtgtttctatatcgtggaaagagagcactgcaagtcttgttcagaagaggacaccaaaaagtgcgttaacacgaaactcgagcagccacaaagcattctgatcgaacataagggaactataattggcaagcaaaattccacctgtacagcaaaagctagttgctggcttgagtctgtaaagagctttttctacggcttaaagaacatgctgtcagggatctttggaaatgtgttcatgggtatctttctcttcttggccccctttattctgctcatcctgttctttatgttcggctggaggatattgttttgtttcaagtgctgccggcgaaccagagggctgttcaaatatcgccacttgaaggatgacgaagagactggatacaggcgtattatcgaaaagctaaacaataaaaagggcaaaaacaagctgctcgatggtgagcggttagcagacagaaggattgccgagctgttttccacaaaaacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16964 - RNA, 5284 nt, synthetic construct
  misc_feature 1..5284: note = mRNA product Design1 comprising derived and/or modified sequence from CCHFV(Turkey-Kelkit06)__GQ337054.1__GP (opt3)
  source 1..5284: mol_type = other RNA
gggagaaagcttaccatgcccaccaacatcatgcacacacctctggtgtgcttcattctctaccttcagctgttgtgtttaggcggggcccatggacaactgaatgctactgagcacaacggtacgaataacaccacagcaccaggcgccagccagtccccgaagccccctatgtctactaccccaccccatgcgcctgaatcaagtacaataaaaccaaccactcccatcagcgaggctgaagggtccggagagacaacctctcctccaaatacgactcagggcctatcgtcaccggaaaccacaagcgagagacccgccactaccagtatttccacatctagcaccgactccacgaaccctactacacagatgaccgataatactccaacacccaccgtctcaacgagtccttcttcttccccatcaacccccagcacaccgcaaggtatccaccatcctgcaaggagtctcctgtctgtttccagccccaagactgtgaccacaccaactcctacctcgcccggggagatgtcttccgaaacatcaagtcagcacagcgccatgtcccggattccaactccccacactgctacgcgcgtatctacagagatcaccaaccatcgaactcctcgtcagagcgaatcaagtgcacagcaaaccacaccatccccgatgaccagccccgcccagtctatacttctgatgtcagctgcccctactgcggtgcaggacatccacccaagtcccacaaatagaagcaaaaggaacttggagacggagattatcctcaccctgtcccagggactgaagaaatattacggcaagattctcaagttactgcatcttactttggaacaagatacagagggcctgctagaatggtgcaaagggaatctcggatctaactgtgacgatgactttttccagaagcggatcgaggaatttttcatgaccggtgagtgctattttaatgaggtcctgcagttcaaaacactttcgactctgagccctaccgaaccatcccacgcacgcttgcccacggccgagccgtttaagtcatacttcgctaaaggctttctcagtatagattctgggtatttcagcgccaagtgttaccctagatcctcagcaagcggactgcaattaattaacgtgacccagcacccagctaggatcgccgaaacacccggccctaagactacctctctgaaaacaattaattgcatcaacctccgggcgtccgtttttaaggagcatcgcgaagtggagatcaacgtccttctgccccagattgccgtgaatttgagtaactgtcacgtagttataaatagccatgtgtgcgactattctctagatactgacggtccagtccgactgcctagaatctaccacgaggggaccttcattcccggaacgtacaaaatcgtgatagataagaaaaacaagctcaatgacaggtgtacactggtgaccaactgcgtcattaaaggccgggaagttcgtaagggccagtccgtgcttcgccaatataagactgagatcaaaatcgggaaggcatcaacaggatttagaaaactgttgagtgaggaaccaggtgatgactgtattagcaggacccagctcctgcggactgaaaccgctgagatccatgacgataattacggcgggccgggagacaagattacaatatgcaacggctcgacgatcgtagatcagcgattaggttccgagctggggtgctataccattaatcgcgtgaaatctttcaagctatgtaagaacagcgccactggcaaaacatgcgaagtcgactcaacccctgtgaagtgtagacagggattctgcctcaaaatcacacaagagggcagggggcacgttaagctgagtcggggatccgaagtggtccttgatgcttgtgactctagctgcgaggtgatgatccccaaaggtactggcgatattttggtagactgttccgggggacagcagcactttctgaaggataatctcatagacctgggctgcccacatatcccccttctgggtcgcatggccatttacatctgtagaatgtcaaaccaccctaggaccacgatggcattcttgttttggttcagctttgggtatgttattacatgcatcttctgtaaggccctcttttacagtctgataatcattggcaccttagggaaaaagatcaaacagtatcgtgagctgaagccacaaacttgcaccatttgcgaaacagctcccgtgaatgcgatcgatgcagagatgcatgacctaaactgttcttacaatatatgcccttactgtgcctcccggctcactagcgacggcctggctcgacacgtcacccagtgcccgaaaagaaaggaaaaggtggaggaaacagagctttatttgaacctggagaggattccatggatcgtccgcaaactcctgcaagtgtcggaatcaacgggggttgccttaaagcggtctagttggctgattgtgcttttggtactcctgaccgtctccctaagccccgtgcagtctgcacctgttggacacggtaaaactatcgagatataccagacaagagaaggcttcgccagcatctgtctgtttatgctcgggtccattctgttcatcgtgtcatgccttgtcaagggattggtggatagtgtaagcgagagctttttcccaggcctgtccgtgtgtaaaacctgctcaattggtagtgttaacgggtttgaaatcgagagccataagtgttattgctccttattctgttgcccctactgcaggcactgttctgctgaccgcgagatacatcagctccacctgtcgatttgcaaaaagcgaaagactggcagcaatgtcatgcttgccgtgtgtaaacggatgtgcttccgtgcaacaatcgaagcgtcaagaagggctctgttgatccgctccattatcaacaccacgtttgtgatttgtatactcactctgaccatctgcgtcgttagtacatctgccgtggagatggaaaatctacctgcaggaacctgggagcgggaagaggatctgactaacttctgtcatcaggagtgccaagtgacagaaaccgagtgtctctgcccgtatgaagccctggtacttagaaagcccttgtttctggacagcattgtcaaaggcatgaagaatttactcaactccacatcactggagacttctcttagcatcgaggctccatggggagccattaatgtgcagagtaccttcaaacctacggtttccacagcaaacatcgctctgagctggtcttcagtggtccacaggggaaataagatattggtgaccggccgatccgaaagtatcatgaagctcgaggaacgcactggtgttagctgggatctgggggtggaggacgcctcggaatctaaattgctgaccgtatccattatggatttaagccagatgtactcacccgtctttgagtatctcagtggagacagacaggtggaggaatggccaaaggcgacatgtactggcgattgccctgagcggtgcggttgtacctcttccacgtgcctgcacaaagaatggagccattcaaggaactggcgttgtaatcccacatggtgctggggcgtggggaccggatgtacttgctgtggcgtcgacgttaaggatcttttcacagaccacatgtttgtgaaatggaaggtagagtacatcaagaccgaagccattgtgtgcgtcgctctgaccagtcaagagcgccagtgtagcttgatcgaggcagggacacggttcaacctcggaccagtgaccataacgctgtccgaaccgagaaatattcagcagaaactacctcccgagatcatcactctgcatccaaagattgaagagggctttttcgatcttatgcacgttcaaaaagtgctctctgccagcaccgtctgcaagctgcagtcctgtacacatggtatacccggggacctacaggtgtaccacatcggaaacctgttaaaaggcgacagggttaatggtcacctcattcataagatcgaatcacactttaacacctcttggatgagttgggatggctgcgacctggattattactgcaacatgggggactggccttcgtgtacatatactggagtgacccagcataatcacgctgccttcgtcaaccttctgaatattgagacggattacacaaagacttttcacttccatagcaaacgagtaaccgcacacggcgacacaccacaattggatctcaaggcgcggcccacctatggggccggaggcatcactgtgctggttgaggtggctgacatggaactacataccaaaaaggtcgagatatccggtctgaaattcgcctctcttgcatgcacagggtgttacgcttgctcaagcggaatctcctgtaaggtgcgcattcacgtagatgaacctgacgagctcacggtgcatgtcaaaagttctgatccggacgttgtggccgcaagcacttcactgatggccagaaagttggagtttggcaccgattccacattcaaggcttttagtgcgatgccaaaaaccagcttatgcttctatatcgtggaaagggagtactgtaagtcttgctccgaagacgacactcagaaatgtgtcgatacacggctggagcagccccaatcaattctcatcgaacacaagggtaccataattggcaaacagaacgacacgtgcactgccaaggcaagctgttggctggagtcggtgaagtctttcttttacgggcttaaaaatatgctgggaagtgtttttggcaacttgttcatcgggatcctactgtttctcgctcctttcgtactgcttgtgttatttttcatgttcggatggaagattctgttttgcttcaaatgctgtcgaagaacacgcggcctctttaagtataggcacttgaaagatgacgaggaaaccggttaccgtcggatcatagagagactgaactccaagaaggggaaaaataggctcctggatggagaccgccttgccgatcgaaagattgccgaactgttcagcaccaaaactcatatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16965 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (opt3)
  source 1..3796: mol_type = other RNA
gggagaaagcttaccatgcacatcagcctgatgtacgccattctctgccttcagctgtgtggcttgggggagacccatggatcccacaacgaaacatctgaggaaccctcagacgattgcgtgagtagaactcaattactgaggacggagaccgctgaaatacatggtgacaattatggcgggcctggagataagatcacaatttgtaacggcagcactatcgtcgaccagcggctaggttccgagctcgggtgctacaccattaatcgcgttcgatctttcaaactgtgtgagaactcggcaacaggaaagaattgcgaaatcgattcagtgccagtaaaatgtcgtcagggctattgccttagaataacccaggagggcagggggcacgtgaagctgagccggggaagtgaagtcgtgttggacgcctgtgatacttcctgcgagatcatgattccgaaaggtacaggcgacatcctcgttgattgttctgggggacaacagcattttctgaaggacaacctgattgatctcggctgccccaagatccctttactgggtaaaatggcgatatacatttgccgcatgagcaatcacccaaagaccacgatggctttcttgttttggttctcctttgggtatgtgatcacttgtattctttgcaaagccatcttctacctgctaatcattgtcggaaccctcggcagaaggctgaagcagtatcgggagcttaaaccccagacatgtactatatgcgaaaccacacctgtgaacgcaatcgacgccgagatgcacgatctgaattgttcatacaacatttgcccatactgtgctagtcgcttgaccagcgacggcctcgcacgacatgtaatccaatgccccaagagaaaggaaaaagttgaggaaacggagctgtatttaaatctggagaggataccttgggtggtccggaagctccttcaggtgtctgaatccactggggtggccctgaaacgttcaagctggttgattgtcctactggttctctttacagtgagtctgtctccagtacagtccgctccgatcggacagggtaagaccatcgaggcctaccgcgcgagagaaggctatactagcatttgtcttttcgtgctggggtcgatcttgtttattgtctcttgcctcatgaaaggactggtggactccgttggcaactcattctttcccggtttaagtatatgtaagacatgcagcatctcctctattaatgggttcgagatcgaaagccacaaatgctactgttcactgttttgctgtccttattgcaggcattgtagtaccgataaggagatccacaagctacacctctccatttgcaaaaagcggaaaacgggcagcaacgtgatgctggcagtctgtaaacttatgtgcttccgagccaccatggaggtgtctaatcgcgctttgttcataagatcaatcattaacacaacttttgtactgtgtatcctcattctggccgtttgcgtggtcagtaccagcgcagtggaaatggagaaccttccagctggaacatgggaaagggaggaagacctgactaatttctgtcatcaagagtgccaggtcaccgagacagaatgcttgtgtccctacgaggccctcgtgctgcggaaacctttatttctggattccaccgcgaagggcatgaagaacctactcaattctacttcgctggaaacgagcctttccatcgaggccccatggggagcaataaacgttcagtcaacatataaacccaccgtgagtactgctaatatcgccttgtcttggagctccgtagagcaccgcgggaacaagattctggtctcaggtagaagcgaatctatcatgaaactcgaggaaaggaccggcatttcctgggacctgggggtggaggatgctagtgaaagcaagttactgacagtttctgtgatggacctttcccaaatgtactcaccggtcttcgagtacttgagtggagatcgtcaggtggaggaatggcctaaagcaacctgcactggcgactgtcccgagcggtgcggttgtacaagctcgacgtgcctccataaggaatggccacactcccgaaattggagatgtaaccctacctggtgctggggcgtagggactggatgtacatgctgtggcctggatgtgaaggacctatttaccgattatatgttcgttaaatggaaggtcgagtacatcaaaacagaagccatagtgtgcgtggagctgacttctcaggagaggcagtgcagcctcattgaagccgggacccgctttaatctgggacccgtcacgatcaccctttcagagccacggaacattcaacagaagttgccccctgaaatcataacactgcatccaagaatcgaggaaggtttctttgacttaatgcacgttcagaaagtgctcagtgcttccactgtgtgtaagctgcagtcttgcacccacggcgtaccgggggaccttcaagtctatcatattggaaatctgttgaagggcgataaagtgaacggtcacctcatccataagattgagccccacttcaatacaagctggatgtcctgggacgggtgtgatctggactactattgcaacatgggcgattggccttcatgtacttacaccggagttacgcagcacaatcatgcgagctttgtgaacctactgaacatcgagacagactataccaaaaatttccactttcatagtaagagggtcactgcacacggcgatacaccacagctcgacctgaaagcccgccccacctacggggctggagaaataactgtgcttgttgaggtggccgatatggaattgcataccaagaaaattgagatctctggcctgaagttcgcatccttagcctgcacaggttgttacgcttgcagctcgtcaatctcttgtaaggtacggattcacgtcgacgagcctgatgaactcacggtgcacgtgaaaagtgacgatccagacgtcgttgccgcatccagctctctgatggcgcgaaaacttgagttcgggaccgacagcacttttaaggctttctccgccatgcccaagacatcactgtgcttttatatcgtggaacgtgagcattgtaagagttgcagcgaagaggataccaagaagtgcgtaaacacaaaactagagcagccgcaatctattctcatagaacacaagggaactatcattggcaaacagaatagcacctgtacggcaaaggcctcatgctggctggagagtgtgaaatccttcttttacggtttgaagaacatgctgtccggcatcttcgggaatgtctttatgggaattttcttatttctcgctcctttcatcctgcttatactgtttttcatgtttggctggagaatcttgttctgtttcaagtgctgtaggcgcacacgggggctctttaaatatagacatctgaaggacgatgaagagaccggatacaggcgaattatcgaaaaactaaacaataagaaaggcaagaacaagctgcttgacggtgagcgcctcgccgatgggcggattgcagagctgttctctactaaaacccacatcggatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16966 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (opt3)
  source 1..3769: mol_type = other RNA
gggagaaagcttaccatggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacaccagttgcgagataatgatcccgaaaggcacaggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggccagggcaagaccatcgaggcatatagagccagggaagggtacacttccatctgtctgtttgtgctcggaagcattctgttcatcgtttcgtgccttatgaaaggtctggtggattctgtcggcaattcctttttccccgggttgtcaatttgtaagacatgcagtataagctccatcaacggatttgagattgaatctcacaaatgttattgcagcctcttctgctgtccttactgccggcattgttcaaccgacaaggagatccacaagctgcatttaagtatctgcaaaaagcgaaaaacgggctccaatgtgatgctggctgtatgtaagctaatgtgcttccgcgccaccatggaagttagcaacagagcactctttattaggtctataatcaatacaactttcgtgctgtgtattcttatcttggctgtctgcgtggtctcaaccagtgccgtggagatggagaacctgccagcgggtacatgggaacgggaggaagatctcactaacttttgtcaccaggagtgccaagttaccgaaacagagtgtctgtgcccctatgaggcccttgtgctgcgcaaacctttgttcctcgacagcaccgcaaaggggatgaagaatctgttaaactccacttctctggaaacgtcgctaagcattgaggctccatggggcgccatcaatgtacagtccacatacaaacccaccgtctcaactgctaacatagccctcagttggtctagcgtggaacacagaggaaataagatcctggtttccggcaggtcagagagcattatgaaacttgaggaacgtaccgggatctcttgggatttgggagtggaggacgcatccgaaagtaagctgctcacagtcagcgtgatggatctgtctcagatgtattccccggtatttgagtacttatcaggtgaccggcaagtggaagagtggcctaaagccacttgcactggcgattgtcccgagcgatgcgggtgtacaagtagcacgtgcctgcataaggaatggccacactcgagaaactggaggtgtaatcctacctggtgctggggagttggcactggttgtacatgctgtgggcttgacgtcaaggatttgttcaccgactacatgtttgtgaaatggaaggtggagtatattaaaacagaagctatcgtctgcgttgagctcacttcccaggaacgccagtgttctctgatagaggcgggcacccggttcaacctaggacccgtgacgattaccctgagcgagccaagaaatatccagcaaaagctgccccctgaaattatcacactccatccaaggatagaggaaggctttttcgaccttatgcacgtgcagaaagtattgtcagcaagtactgtctgcaagctgcagtcctgcacccatggggtgccgggagatttacaggtttaccacatcggtaacctcctgaagggcgacaaagtgaatgggcaccttattcataagatcgagccccactttaacacatcttggatgagctgggatggatgtgacctggattattactgcaatatgggcgactggccttcctgtacttataccggtgtcacgcaacataaccacgcctcattcgtgaatttgctcaacattgaaacagattacaccaaaaactttcacttccatagcaagcgcgttactgctcacggggacacaccacagctggatctaaaagcccgacccacctatggcgcaggagagatcactgtgctggtagaggtcgccgacatggaactccataccaagaaaatagagattagtggcctgaagttcgcttctcttgcctgcacagggtgttacgcatgctccagctcgatctcatgtaaggtgcggatccacgtggatgaacctgacgagttgacggtccatgttaaatctgatgacccagacgtggtagcggctagttccagcctgatggcccgtaagttagagtttggaaccgattctactttcaaagcatttagcgccatgcccaagacatccctctgcttctacattgtggaaagagagcactgtaaatcatgcagtgaagaggacaccaagaagtgtgtcaatacaaaactggaacagccgcagagcatccttattgagcacaagggcactataatcggtaaacaaaactctacctgcacggctaaggcctcctgctggctggagtcagtgaaaagtttcttttatgggctaaagaatatgctcagcggaatttttggcaacgttttcatgggtatctttctgttcttggcaccttttattctgttaatcctcttctttatgttcggctggaggatactgttctgttttaagtgctgtcgccggacaagagggcttttcaaatacaggcatctgaaggatgacgaagagaccggatatcgacgcatcattgaaaaattgaataacaagaaaggcaagaataagctcctggatggggagcggctagctgacggaagaatcgccgaactgttttccactaaaacccacattggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16967 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (opt3)
  source 1..3190: mol_type = other RNA
gggagaaagcttaccatggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacacaagttgcgagataatgatcccgaaaggcacaggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggcagaaagcccctgtttctcgattccaccgcaaaaggcatgaagaatctgcttaacagcacttcgctggagacatctttgtccatcgaagccccttggggagctatcaatgtgcagtcaacctataaaccaacggttagtaccgccaacattgcactcagctggtcctctgtggagcacagggggaataagatcctggtcagcggtcggtcagaaagtattatgaagttagaggaacgaacaggcatatcctgggacctgggggtggaggatgctagcgagtctaaactactcactgtatcagttatggacctgagtcagatgtacagccccgtgttcgaatatctttccggagatcgccaagtcgaggaatggcctaaggccacctgtacaggcgactgcccagagagatgtggttgcacttcttcgacctgtttgcataaagaatggccccacagcaggaactggcggtgcaacccgacatggtgctggggcgtggggaccggatgtacttgctgtggcctggatgtcaaggacctctttacggattacatgttcgtgaaatggaaggttgagtatatcaagacagaggcgattgtgtgcgtagaactgacctcccaggagcgccagtgttcacttatcgaagccgggactagatttaatctgggacctgtcaccatcacattgagtgagcccaggaacattcaacagaaactcccacctgagataatcaccctgcatccccgtattgaagagggtttcttcgacttaatgcacgtgcagaaggttctgtctgcaagcactgtgtgcaaactacagtcctgtacacacggcgtcccaggggatctccaagtgtaccatatcggaaatctgcttaagggcgacaaagtaaacggtcacttgattcataagatcgaaccccactttaatacgtcatggatgagctgggacgggtgcgatctggactattactgtaacatgggcgattggccttcttgcacctacactggagtgacacagcataatcacgcttccttcgttaacctcctgaatatagagaccgactatacaaagaactttcacttccatagtaaacgggtcactgcccacggcgataccccacagttagacctgaaggctcgaccgacgtacggggccggagaaatcaccgtgcttgtggaggtcgcagatatggagttgcatactaaaaagattgaaatcagcggtctcaaatttgcctctctggcttgtactggctgctatgcgtgctcctcaagtattagctgtaaggttagaatccacgtggacgagcccgatgaactaaccgtgcacgtaaagtcggacgatcctgacgtcgtggcagcctcctctagcctgatggctaggaaactcgagttcgggacagattcaacttttaaggccttcagtgcaatgccaaaaacctccctgtgcttttacatagttgaacgcgagcattgtaagtcttgcagcgaggaagacacgaaaaagtgtgtgaatacaaaacttgagcagccccaatccattttgatcgaacacaagggaaccattatcggcaagcagaactcaacttgcacagccaaagctagctgttggctggagagtgtcaagtctttcttttatggtctcaaaaatatgttatccgggatattcggcaacgtgtttatgggaatcttcctgttccttgccccttttattctgttgatcctcttctttatgttcggctggcggattctgttttgcttcaagtgttgcagaaggacccgcgggctatttaaataccgacatctgaaggacgatgaagagactggatatcggcgtatcatagagaagctcaataacaaaaagggcaaaaacaagctgcttgacggtgaaagattggcagatgggaggattgcggagctgttcagcaccaaaacacacatcggatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16968 - RNA, 1246 nt, synthetic construct
  misc_feature 1..1246: note = mRNA product Design1 comprising derived and/or modified sequence from CCHVF(10200)__U39455.2__IgE-leader_Gn (opt3)
  source 1..1246: mol_type = other RNA
gggagaaagcttaccatggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacacaagttgcgagataatgatcccgaaaggcactggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16969 - RNA, 2206 nt, synthetic construct
  misc_feature 1..2206: note = mRNA product Design1 comprising derived and/or modified sequence from CCHVF(10200)__U39455.2__IgE-leader_Gc (opt3)
  source 1..2206: mol_type = other RNA
gggagaaagcttaccatggactggacctggatcctgttcctcgtggccgctgcaacaagagtccacagctttcttgattccactgccaagggcatgaaaaacctgttaaattctacgtcattggagaccagtctgagcattgaagcgccctggggagctataaacgttcagtccacatacaagcctactgtgtctaccgccaatatcgcactatcgtggtcaagcgtagagcatagggggaacaaaattctcgtgagtggtcggtccgaatctatcatgaagctggaggaacgcacaggcattagctgggaccttggggtcgaggatgcctccgagtcaaaactgttgaccgtgagtgttatggacctcagccagatgtattctccagtgttcgaatacctgtccggagatcgacaggtcgaggaatggccgaaggctacttgcacaggcgactgtcccgagcgttgcggttgtacctcaagcacgtgcctgcacaaggagtggcctcatagtagaaattggaggtgtaacccaacttggtgctggggagtggggaccggctgtacatgctgtggcctcgatgtaaaagacttatttactgattatatgttcgttaagtggaaagtggaatacatcaagaccgaggcaatagtctgcgtggaactgacatctcaggagcggcagtgttcccttatcgaagccgggacccgctttaatttgggacccgtgacgattactctgagcgagcctagaaacatccaacagaaactaccacccgagattatcacactccaccctaggatagaagagggtttctttgacctgatgcatgtccagaaggttctttcggcttctaccgtgtgcaagctgcagtcctgcactcacggcgtaccaggggatttgcaagtgtatcacattggaaatctcctgaaaggcgacaaggtcaacggtcatttaatccacaaaattgaaccgcatttcaatacatcatggatgagttgggatgggtgtgacctggactactattgcaacatgggagattggcccagctgtacctacacgggcgtgacccagcacaatcacgcctcctttgttaacctccttaatatcgagacagactacactaagaacttccattttcactctaaacgggtgaccgcgcatggcgatacacctcagctggacttgaaggcacgcccaacttatggggccggagaaatcaccgtcctagtggaggtagctgatatggagctgcacaccaaaaagattgaaataagcggtctcaagttcgcctcactggcatgcacaggctgttacgcttgcagttccagcatctcttgtaaagttcgaatccatgtggacgagcccgatgaacttactgtccacgtgaagtcagacgatcctgacgtcgtggccgcgagtagctccctgatggccagaaaattggagtttgggacggattctacattcaaggcattctcggctatgccaaaaaccagcctctgcttttatattgttgaaagggagcactgtaagtcctgctcagaggaagacactaagaaatgtgtgaacaccaagctggagcagccccaaagtatattaattgaacataaaggaacaatcatcggcaagcaaaattctacctgcactgccaaagctagctgctggctggagtccgtaaagtcattcttttacggtctaaagaacatgctcagcgggattttcggcaatgtctttatgggaatcttcctgtttcttgccccgttcattttgctgatactctttttcatgtttggctggcggatcctgttctgttttaaatgctgtcgtcgcacaagagggcttttcaagtataggcacctgaaagacgatgaggaaacgggataccggcgaattatcgagaagttgaacaataaaaagggtaagaacaaactcctggacggcgaacgcttagcagatgggagaatcgccgagctgttctctaccaagactcatattggatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16970 - RNA, 1666 nt, synthetic construct
  misc_feature 1..1666: note = mRNA product Design1 comprising derived and/or modified sequence from CCHFV(10200)__NC_005302.1/U88410.1__N (opt1)
  source 1..1666: mol_type = other RNA
gggagaaagcttaccatggagaacaagatcgaggtgaacaacaaggacgagatgaaccgctggttcgaggagttcaagaagggcaacgggctggtcgacaccttcaccaacagctactccttctgcgagagcgtgcccaacctcgaccggttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgacgtgcccaagatcgagcagctgaccgggtaccagcaggccgccctgaagtggcgcaaggacatcggcttccgggtgaacgcgaacaccgccgccctcagcaacaaggtcctggccgagtacaaggtgcccggcgagatcgtgatgtccgtcaaggagatgctgagcgacatgatccgccggcgcaacctcatcctgaaccgcgggggcgacgagaacccccgggggccggtgtcccacgagcacgtggactggtgccgggagttcgtcaagggcaagtacatcatggccttcaacccgccctggggcgacatcaacaagagcgggcgctccggcatcgcgctggtggccaccgggctcgccaagctggccgagacggagggcaaggggatcttcgacgaggccaagaagaccgtggaggcgctgaacggctacctcgacaagcacaaggacgaggtcgaccgggccagcgccgactccatgatcaccaacctgctgaagcacatcgccaaggcccaggagctctacaagaacagctccgcgctgcgcgcccagagcgcccagatcgacaccgccttcagctcctactactggctgtacaaggccggcgtgacgcccgagaccttccccaccgtgagccagttcctcttcgagctggggaagcagccccggggcaccaagaagatgaagaaggcgctgctctccacgcccatgaagtgggggaagaagctgtacgagctgttcgccgacgacagcttccagcagaaccgcatctacatgcaccccgccgtcctcaccgccggccggatctccgagatgggggtgtgcttcggcaccatcccggtggcgaaccccgacgacgccgcccagggcagcgggcacaccaagtccatcctgaacctgcgcacgaacaccgagaccaacaacccctgcgccaagaccatcgtcaagctgttcgaggtgcagaagacgggcttcaacatccaggacatggacatcgtcgccagcgagcacctcctgcaccagtccctcgtggggaagcagagccccttccagaacgcgtacaacgtgaagggcaacgccacctccgccaacatcatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16971 - RNA, 1666 nt, synthetic construct
  misc_feature 1..1666: note = mRNA product Design1 comprising derived and/or modified sequence from CCHFV(Turkey-Kelkit06)__GQ337053.1__N (opt1)
  source 1..1666: mol_type = other RNA
gggagaaagcttaccatggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaaggacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgcccaagcacatcgccaaggcgcaggagctgtacaagaacagctccgccctccgggcccagggcgcccagatcgacacccccttcagcagcttctactggctgtacaaggccggcgtgacccccgagaccttccccacgatctcccagttcctgttcgagctcggggagcagccccgcggcaccaagaagatgaagaaggcgctgctgagcaccccgatgaagtgggggaagaagctctacgagctgttcgccgacgactccttccagcagaaccggatctacatgcaccccgccgtgctgaccgccggccgcatcagcgagatgggggtctgcttcggcacgatccccgtggcgaaccccgacgacgccgcccagggctccgggcacaccaagagcatcctcaacctgcggacctccaccgagacgaacaacccgtgcgccaagaccatcgtgaagctgttcgagatccaggagaccggcttcaacatccaggacatggacatcgtcgccagcgagcacctcctgcaccagtccatcgtggggaagcagagccccttccagaacgcgtacaacgtcaagggcaacgccacctccgccaacatcatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16972 - RNA, 5272 nt, synthetic construct
  misc_feature 1..5272: note = mRNA product Design1 comprising derived and/or modified sequence from CCHFV(10200)__U39455.2__GP (opt1)
  source 1..5272: mol_type = other RNA
gggagaaagcttaccatgcacatcagcctgatgtacgccatcctctgcctgcagctgtgcggcctcggggagacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgcccccaccgtgcggacctccctgccgaacagcccctccacgcccagcacgccccaggacacccaccacccggtgcgcaacctcctgtccgtcaccagccccgggcccgacgagaccagcaccccctccggcaccggcaaggagagctccgccaccagctccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgcccggcaccctctccaccaccgagagcacgccggccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacacccccgggccgaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatccccggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggttccggcgcctcctgagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16973 - RNA, 5272 nt, synthetic construct
  misc_feature 1..5272: note = mRNA product Design1 comprising derived and/or modified sequence from CCHFV(IbAr10200)__AF467768.2__GP (opt1)
  source 1..5272: mol_type = other RNA
gggagaaagcttaccatgcacatcagcctgatgtacgccatcctctgcctgcagctgtgcggcctcggggagacccacggctcccacaacgagacccgccacaacaagacggacaccatgaccacccccggggacaacccgagctccgagccgcccgtgagcacggccctgtccatcaccctggaccccagcaccgtcacccccacgacccccgcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccctccggcaccggcaaggagagctccgccaccagctccccgcaccccgtgagcaaccggcccccgacgccgcccgcgaccgcccaggggcccaccgagaacgactcccacaacgccaccgagcaccccgagagcctgacgcagtccgccacccccggcctcatgaccagccccacccagatcgtgcacccgcagtccgcgacccccatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcgcctgggctccgagctggggtgctacaccatcaaccgggtccgcagcttcaagctgtgcgagaactccgcgaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggccttcctcttctggttctccttcgggtacgtgatcacgtgcatcctgtgcaaggccatcttctacctgctcatcatcgtgggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgcctgaccagcgacggcctcgcccggcacgtgatccagtgccccaagcgcaaggagaaggtggaggagaccgagctgtacctgaacctcgagcggatcccgtgggtcgtgcgcaagctgctgcaggtctccgagagcacgggcgtcgccctcaagcggtccagctggctgatcgtgctgctcgtgctgttcaccgtctccctgagccccgtgcagtccgcgcccatcgggcagggcaagaccatcgaggcctaccgcgcccgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgcgaccatggaggtgtccaaccgcgccctgttcatccggagcatcatcaacaccacgttcgtcctctgcatcctgatcctggccgtgtgcgtggtctccaccagcgccgtggagatggagaacctccccgccgggacctgggagcgcgaggaggacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccctggggcgccatcaacgtgcagagcacctacaagcccaccgtgtccaccgccaacatcgcgctgagctggagctccgtcgagcaccgcgggaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacgtgcaccggcgactgccccgagcgctgcgggtgcacgagctccacgtgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccgcccgagatcatcaccctccacccccgcatcgaggaggggttcttcgacctgatgcacgtgcagaaggtcctgagcgcgtccaccgtgtgcaagctccagagctgcacgcacggcgtccccggggacctgcaggtctaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcccacggggacacgccgcagctggacctcaaggcccgccccacctacggcgcgggggagatcaccgtcctggtggaggtggccgacatggagctgcacaccaagaagatcgagatctccggcctcaagttcgccagcctggcctgcacgggctgctacgcctgctccagcgggatctcctgcaaggtccggatccacgtggacgagcccgacgagctgaccgtgcacgtcaagagcgacgaccccgacgtggtggcggcctccagctccctcatggcccgcaagctggagttcggcaccgacagcaccttcaaggccttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgcgaaggccagctgctggctggagtccgtgaagtccttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgcgggctgttcaagtaccggcacctgaaggacgacgaggagaccggctaccgccggatcatcgagaagctcaacaacaagaagggcaagaacaagctgctggacggggagcgcctcgccgaccggcgcatcgccgagctgttcagcacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16974 - RNA, 5284 nt, synthetic construct
  misc_feature 1..5284: note = mRNA product Design1 comprising derived and/or modified sequence from CCHFV(Turkey-Kelkit06)__GQ337054.1__GP (opt1)
  source 1..5284: mol_type = other RNA
gggagaaagcttaccatgcccaccaacatcatgcacaccccgctggtgtgcttcatcctctacctgcagctgctctgcctgggcggggcccacggccagctgaacgccacggagcacaacgggaccaacaacaccaccgcgcccggcgccagccagtcccccaagcccccgatgagcacgaccccgccccacgcccccgagtccagcaccatcaagccgaccacgcccatctccgaggccgaggggagcggcgagaccacctccccgcccaacaccacgcagggcctcagctccccggagaccaccagcgagcgccccgccaccacgtccatcagcacctccagcaccgactccaccaaccccacgacccagatgaccgacaacacccccacgccgaccgtcagcacctcccccagctccagccccagcaccccctccacgccgcaggggatccaccaccccgcgcggagcctgctgtccgtgagctcccccaagaccgtgaccacccccacgccgaccagccccggcgagatgtccagcgagacctccagccagcactccgccatgagccgcatccccaccccgcacacggccacccgggtctccaccgagatcaccaaccaccgcaccccgcggcagagcgagtccagcgcccagcagacgaccccctcccccatgaccagcccggcgcagtccatcctcctgatgagcgccgcccccaccgccgtgcaggacatccaccccagccccacgaaccgctccaagcggaacctggagaccgagatcatcctcaccctgagccaggggctgaagaagtactacggcaagatcctcaagctgctgcacctcaccctggagcaggacacggaggggctgctcgagtggtgcaagggcaacctgggctccaactgcgacgacgacttcttccagaagcgcatcgaggagttcttcatgaccggggagtgctacttcaacgaggtgctgcagttcaagaccctcagcaccctgtccccgacggagcccagccacgcccggctgcccaccgcggagcccttcaagtcctacttcgccaagggcttcctcagcatcgactccgggtacttcagcgccaagtgctacccgcgctccagcgcctccggcctgcagctgatcaacgtcacccagcaccccgcccggatcgcggagacccccggccccaagacgaccagcctcaagaccatcaactgcatcaacctgcgcgcctccgtgttcaaggagcaccgggaggtggagatcaacgtcctgctcccgcagatcgccgtgaacctgagcaactgccacgtggtcatcaactcccacgtgtgcgactacagcctggacaccgacgggcccgtgcgcctcccccggatctaccacgagggcacgttcatccccgggacctacaagatcgtcatcgacaagaagaacaagctgaacgaccgctgcaccctggtgaccaactgcgtgatcaagggccgggaggtccgcaaggggcagagcgtgctccggcagtacaagacggagatcaagatcggcaaggcctccaccggcttccgcaagctgctgagcgaggagccgggggacgactgcatctcccggacccagctcctgcgcaccgagacggccgagatccacgacgacaactacggcgggcccggcgacaagatcaccatctgcaacgggagcaccatcgtggaccagcgcctgggctccgagctcggctgctacaccatcaaccgggtcaagagcttcaagctgtgcaagaactccgcgacggggaagacctgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcacgggcgacatcctggtggactgctccgggggccagcagcacttcctgaaggacaacctcatcgacctggggtgcccgcacatccccctgctcggccggatggccatctacatctgccgcatgagcaaccacccccggaccaccatggccttcctgttctggttctccttcggctacgtcatcacgtgcatcttctgcaaggccctgttctacagcctcatcatcatcgggaccctgggcaagaagatcaagcagtaccgcgagctgaagccccagacgtgcaccatctgcgagaccgcgccggtgaacgccatcgacgccgagatgcacgacctcaactgctcctacaacatctgcccctactgcgccagccggctgacctccgacgggctggcgcgccacgtgacgcagtgccccaagcggaaggagaaggtcgaggagaccgagctctacctgaacctggagcgcatcccgtggatcgtgcggaagctcctccaggtgagcgagagcaccggcgtcgccctgaagcgctccagctggctcatcgtgctgctggtgctcctgaccgtctccctgagccccgtgcagtccgcccccgtggggcacggcaagacgatcgagatctaccagacccgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccgtactgccgccactgctccgccgaccgggagatccaccagctgcacctgagcatctgcaagaagcgcaagaccggctccaacgtcatgctcgcggtgtgcaagcggatgtgcttccgcgccacgatcgaggccagccgccgggccctgctgatccgcagcatcatcaacaccaccttcgtgatctgcatcctcaccctgacgatctgcgtcgtgtccaccagcgccgtggagatggagaacctgcccgcgggcacctgggagcgggaggaggacctcaccaacttctgccaccaggagtgccaggtcacggagaccgagtgcctgtgcccctacgaggccctggtgctccgcaagcccctgttcctggactccatcgtgaaggggatgaagaacctcctgaacagcacctccctggagaccagcctctccatcgaggccccgtggggcgccatcaacgtccagagcacgttcaagcccaccgtgtccaccgccaacatcgcgctgagctggtccagcgtggtccaccgggggaacaagatcctggtgaccggccgctccgagagcatcatgaagctcgaggagcggacgggggtgtcctgggacctgggcgtcgaggacgccagcgagtccaagctgctcaccgtgagcatcatggacctgtcccagatgtacagccccgtgttcgagtacctgagcggcgaccgccaggtcgaggagtggcccaaggcgacctgcaccggggactgcccggagcggtgcggctgcacgtccagcacgtgcctccacaaggagtggtcccacagccgcaactggcggtgcaaccccacctggtgctggggcgtgggcaccgggtgcacgtgctgcggcgtggacgtcaaggacctgttcaccgaccacatgttcgtgaagtggaaggtggagtacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaggagggcttcttcgacctgatgcacgtccagaaggtgctcagcgcctccaccgtgtgcaagctgcagagctgcacgcacgggatccccggcgacctgcaggtctaccacatcggcaacctcctgaagggggaccgggtgaacggccacctgatccacaagatcgagtcccacttcaacaccagctggatgtcctgggacgggtgcgacctcgactactactgcaacatgggcgactggccgagctgcacctacaccggggtcacgcagcacaaccacgccgccttcgtgaacctgctgaacatcgagaccgactacaccaagaccttccacttccactccaagcgcgtgacggcgcacggcgacaccccgcagctcgacctgaaggcccggcccacctacggcgccgggggcatcaccgtcctggtggaggtggccgacatggagctccacacgaagaaggtcgagatcagcgggctgaagttcgcctccctggcgtgcaccggctgctacgcctgcagctccgggatcagctgcaaggtgcgcatccacgtggacgagcccgacgagctcaccgtccacgtcaagagctccgacccggacgtggtcgccgccagcacctccctgatggcccggaagctggagttcggcacggacagcaccttcaaggcgttctccgccatgcccaagaccagcctctgcttctacatcgtggagcgcgagtactgcaagtcctgcagcgaggacgacacccagaagtgcgtggacacgcggctggagcagccccagtccatcctgatcgagcacaagggcaccatcatcgggaagcagaacgacacgtgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacgcggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16975 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (opt1)
  source 1..3796: mol_type = other RNA
gggagaaagcttaccatgcacatcagcctgatgtacgccatcctctgcctgcagctgtgcggcctcggggagacccacggctcccacaacgagaccagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16976 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (opt1)
  source 1..3769: mol_type = other RNA
gggagaaagcttaccatggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16977 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (opt1)
  source 1..3190: mol_type = other RNA
gggagaaagcttaccatggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16978 - RNA, 1246 nt, synthetic construct
  misc_feature 1..1246: note = mRNA product Design1 comprising derived and/or modified sequence from CCHVF(10200)__U39455.2__IgE-leader_Gn (opt1)
  source 1..1246: mol_type = other RNA
gggagaaagcttaccatggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16979 - RNA, 2206 nt, synthetic construct
  misc_feature 1..2206: note = mRNA product Design1 comprising derived and/or modified sequence from CCHVF(10200)__U39455.2__IgE-leader_Gc (opt1)
  source 1..2206: mol_type = other RNA
gggagaaagcttaccatggactggacctggatcctgttcctcgtggccgccgcgacccgcgtccacagcttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16980 - RNA, 1666 nt, synthetic construct; identical to SEQ ID NO: 16970
  misc_feature 1..1666: note = mRNA product Design1 comprising derived and/or modified sequence from CCHFV(10200)__NC_005302.1/U88410.1__N (opt1)
  source 1..1666: mol_type = other RNA

SEQ ID NO: 16981 - RNA, 1666 nt, synthetic construct; identical to SEQ ID NO: 16971
  misc_feature 1..1666: note = mRNA product Design1 comprising derived and/or modified sequence from CCHFV(Turkey-Kelkit06)__GQ337053.1__N (opt1)
  source 1..1666: mol_type = other RNA

SEQ ID NO: 16982 - RNA, 5272 nt, synthetic construct
  misc_feature 1..5272: note = mRNA product Design1 comprising derived and/or modified sequence from CCHFV(10200)__U39455.2__GP (opt1)
  source 1..5272: mol_type = other RNA
gggagaaagcttaccatgcacatcagcctgatgtacgccatcctctgcctgcagctgtgcggcctcggggagacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgcccccaccgtgcggacctccctgccgaacagcccctccacgcccagcacgccccaggacacccaccacccggtgcgcaacctcctgtccgtcaccagccccgggcccgacgagaccagcaccccctccggcaccggcaaggagagctccgccaccagctccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgcccggcaccctctccaccaccgagagcacgccggccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacacccccgggccgaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatccccggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggttccggcgcctcctgagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctccagcacgtgcctgcacaaggagtggccccactcccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16983 - RNA, 5272 nt, synthetic construct
  misc_feature 1..5272: note = mRNA product Design1 comprising derived and/or modified sequence from CCHFV(IbAr10200)__AF467768.2__GP (opt1)
  source 1..5272: mol_type = other RNA
gggagaaagcttaccatgcacatcagcctgatgtacgccatcctctgcctgcagctgtgcggcctcggggagacccacggctcccacaacgagacccgccacaacaagacggacaccatgaccacccccggggacaacccgagctccgagccccccgtgagcacggccctgtccatcaccctggaccccagcaccgtcaccccgacgacccccgcgtccggcctcgaggggagcggcgaggtgtacacctccccccccatcaccacgggcagcctgccgctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccgtccggcaccggcaaggagagctccgccaccagctccccccaccccgtgagcaaccggcccccgacgccccccgcgaccgcccaggggcccaccgagaacgactcccacaacgccaccgagcacccggagagcctgacgcagtccgccacccccggcctcatgaccagccccacccagatcgtgcacccgcagtccgcgacccccatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcgcctgggctccgagctggggtgctacaccatcaaccgggtccgcagcttcaagctgtgcgagaactccgcgaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggccttcctcttctggttctccttcgggtacgtgatcacctgcatcctgtgcaaggccatcttctacctgctcatcatcgtgggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgcctgaccagcgacggcctcgcccggcacgtgatccagtgccccaagcgcaaggagaaggtggaggagaccgagctgtacctgaacctcgagcggatcccgtgggtcgtgcgcaagctgctgcaggtgtccgagagcacgggcgtcgccctcaagcggtccagctggctgatcgtgctgctcgtgctgttcaccgtctccctgagccccgtgcagtccgcgcccatcgggcagggcaagaccatcgaggcctaccgcgcccgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgcgaccatggaggtgtccaaccgcgccctgttcatccggagcatcatcaacaccacgttcgtcctctgcatcctgatcctggccgtgtgcgtggtctccaccagcgccgtggagatggagaacctccccgccgggacctgggagcgcgaggaggacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccctggggggccatcaacgtgcagagcacctacaagcccaccgtgtccaccgccaacatcgcgctgagctggagctccgtcgagcaccgcggcaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacctgcaccggcgactgccccgagcgctgcgggtgcacgagctccacctgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccccccgagatcatcaccctccacccgcgcatcgaggaggggttcttcgacctgatgcacgtgcagaaggtcctgagcgcgtccaccgtgtgcaagctccagagctgcacgcacggcgtccccggggacctgcaggtgtaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcccacggggacacgccgcagctggacctcaaggcccgccccacctacggcgcgggggagatcaccgtcctggtggaggtggccgacatggagctgcacaccaagaagatcgagatctccggcctcaagttcgccagcctggcctgcacgggctgctacgcctgctccagcgggatctcctgcaaggtccggatccacgtggacgagcccgacgagctgaccgtgcacgtcaagagcgacgaccccgacgtggtggcggcctccagctccctcatggcccgcaagctggagttcggcaccgacagcaccttcaaggccttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgcgaaggccagctgctggctggagtccgtgaagagcttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgcgggctgttcaagtaccggcacctgaaggacgacgaggagaccggctaccgccggatcatcgagaagctcaacaacaagaagggcaagaacaagctgctggacggggagcgcctcgccgaccggcgcatcgccgagctgttcagcacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16984 - RNA, 5284 nt, synthetic construct
  misc_feature 1..5284: note = mRNA product Design1 comprising derived and/or modified sequence from CCHFV(Turkey-Kelkit06)__GQ337054.1__GP (opt1)
  source 1..5284: mol_type = other RNA
gggagaaagcttaccatgcccaccaacatcatgcacaccccgctggtgtgcttcatcctctacctgcagctgctctgcctgggcggggcccacggccagctgaacgccacggagcacaacgggaccaacaacaccaccgcgcccggcgccagccagtcccccaagcccccgatgagcacgacccccccccacgcccccgagtccagcaccatcaagccgaccacgcccatctccgaggccgaggggagcggcgagaccacctccccccccaacaccacgcagggcctcagctccccggagaccaccagcgagcgccccgccaccacgtccatcagcacctccagcaccgactccaccaaccccacgacccagatgaccgacaacacccccacgccgaccgtcagcacctcccccagctccagccccagcaccccctccacgccgcaggggatccaccaccccgcgcggagcctgctgtccgtgagctcccccaagaccgtgaccacccccacgccgaccagccccggcgagatgtccagcgagacctccagccagcactccgccatgagccgcatccccaccccccacacggccacccgggtctccaccgagatcaccaaccaccgcaccccgcggcagagcgagtccagcgcccagcagacgaccccctcccccatgaccagcccggcgcagtccatcctcctgatgagcgccgcccccaccgccgtgcaggacatccaccccagccccacgaaccgctccaagcggaacctggagaccgagatcatcctcaccctgagccaggggctgaagaagtactacggcaagatcctcaagctgctgcacctcaccctggagcaggacacggaggggctgctcgagtggtgcaagggcaacctgggctccaactgcgacgacgacttcttccagaagcgcatcgaggagttcttcatgaccggggagtgctacttcaacgaggtgctgcagttcaagaccctcagcaccctgtccccgacggagcccagccacgcccggctgcccaccgcggagcccttcaagtcctacttcgccaagggcttcctcagcatcgactccgggtacttcagcgccaagtgctacccgcgctccagcgcctccggcctgcagctgatcaacgtcacccagcaccccgcccggatcgcggagacccccggccccaagacgaccagcctcaagaccatcaactgcatcaacctgcgcgcctccgtgttcaaggagcaccgggaggtggagatcaacgtcctgctcccgcagatcgccgtgaacctgagcaactgccacgtggtcatcaactcccacgtgtgcgactacagcctggacaccgacgggcccgtgcgcctcccccggatctaccacgagggcacgttcatccccgggacctacaagatcgtcatcgacaagaagaacaagctgaacgaccgctgcaccctggtgaccaactgcgtgatcaagggccgggaggtccgcaaggggcagagcgtgctccggcagtacaagacggagatcaagatcggcaaggcctccaccggcttccgcaagctgctgagcgaggagccgggggacgactgcatctcccggacccagctcctgcgcaccgagacggccgagatccacgacgacaactacggcgggcccggcgacaagatcaccatctgcaacgggagcaccatcgtggaccagcgcctgggctccgagctcggctgctacaccatcaaccgggtcaagagcttcaagctgtgcaagaactccgcgacggggaagacctgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcacgggcgacatcctggtggactgctccgggggccagcagcacttcctgaaggacaacctcatcgacctggggtgcccgcacatccccctgctcggccggatggccatctacatctgccgcatgagcaaccacccccggaccaccatggccttcctgttctggttctccttcggctacgtcatcacctgcatcttctgcaaggccctgttctacagcctcatcatcatcgggaccctgggcaagaagatcaagcagtaccgcgagctgaagccccagacgtgcaccatctgcgagaccgcgccggtgaacgccatcgacgccgagatgcacgacctcaactgctcctacaacatctgcccctactgcgccagccggctgacctccgacgggctggcgcgccacgtgacgcagtgccccaagcggaaggagaaggtcgaggagaccgagctctacctgaacctggagcgcatcccgtggatcgtgcggaagctcctgcaggtgagcgagagcaccggcgtcgccctgaagcgctccagctggctcatcgtgctgctggtgctcctgaccgtctccctgagccccgtgcagtccgcccccgtggggcacggcaagacgatcgagatctaccagacccgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccgtactgccgccactgctccgccgaccgggagatccaccagctgcacctgagcatctgcaagaagcgcaagaccggctccaacgtcatgctcgcggtgtgcaagcggatgtgcttccgcgccacgatcgaggccagccgccgggccctgctgatccgcagcatcatcaacaccaccttcgtgatctgcatcctcaccctgacgatctgcgtcgtgtccaccagcgccgtggagatggagaacctgcccgcgggcacctgggagcgggaggaggacctcaccaacttctgccaccaggagtgccaggtcacggagaccgagtgcctgtgcccctacgaggccctggtgctccgcaagcccctgttcctggactccatcgtgaaggggatgaagaacctcctgaacagcacctccctggagaccagcctctccatcgaggccccgtggggcgccatcaacgtccagagcacgttcaagcccaccgtgtccaccgccaacatcgcgctgagctggtccagcgtggtccaccgggggaacaagatcctggtgaccggccgctccgagagcatcatgaagctcgaggagcggacgggggtgtcctgggacctgggcgtcgaggacgccagcgagtccaagctgctcaccgtgagcatcatggacctgtcccagatgtacagccccgtgttcgagtacctgagcggcgaccgccaggtcgaggagtggcccaaggccacctgcaccggggactgcccggagcggtgcggctgcacgtccagcacctgcctccacaaggagtggtcccacagccgcaactggcggtgcaaccccacctggtgctggggggtgggcaccgggtgcacgtgctgcggcgtggacgtcaaggacctgttcaccgaccacatgttcgtgaagtggaaggtggagtacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaggagggcttcttcgacctgatgcacgtccagaaggtgctcagcgcctccaccgtgtgcaagctgcagagctgcacgcacgggatccccggcgacctgcaggtctaccacatcggcaacctcctgaagggggaccgggtgaacggccacctgatccacaagatcgagtcccacttcaacaccagctggatgtcctgggacgggtgcgacctcgactactactgcaacatgggcgactggccgagctgcacctacaccggggtcacgcagcacaaccacgccgccttcgtgaacctgctgaacatcgagaccgactacaccaagaccttccacttccactccaagcgcgtgacggcgcacggcgacaccccccagctcgacctgaaggcccggcccacctacggcgccgggggcatcaccgtcctggtggaggtggccgacatggagctccacacgaagaaggtcgagatcagcgggctgaagttcgcctccctggcgtgcaccggctgctacgcctgcagctccgggatcagctgcaaggtgcgcatccacgtggacgagcccgacgagctcaccgtccacgtgaagagctccgacccggacgtggtcgccgccagcacctccctgatggcccggaagctggagttcggcacggacagcaccttcaaggcgttctccgccatgcccaagaccagcctctgcttctacatcgtggagcgcgagtactgcaagtcctgcagcgaggacgacacccagaagtgcgtggacacgcggctggagcagccccagtccatcctgatcgagcacaagggcaccatcatcgggaagcagaacgacacctgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacgcggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16985 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (opt1)
  source 1..3796: mol_type = other RNA
gggagaaagcttaccatgcacatcagcctgatgtacgccatcctctgcctgcagctgtgcggcctcggggagacccacggctcccacaacgagaccagcgaggagccctccgacgactgcgtgagccgcacgcagctgctgcggaccgagaccgccgagatccacggggacaactacggcgggccgggcgacaagatcaccatctgcaacggctccacgatcgtcgaccagcgcctcgggagcgagctgggctgctacaccatcaaccgggtgcgctccttcaagctgtgcgagaacagcgcgaccgggaagaactgcgagatcgactccgtgcccgtcaagtgccggcagggctactgcctccgcatcacccaggaggggcggggccacgtgaagctgagccgcggctccgaggtggtcctggacgcctgcgacacgagctgcgagatcatgatccccaaggggaccggcgacatcctcgtggactgctccgggggccagcagcacttcctgaaggacaacctgatcgacctcggctgccccaagatcccgctgctggggaagatggccatctacatctgccggatgagcaaccaccccaagaccaccatggccttcctcttctggttctccttcggctacgtgatcacgtgcatcctgtgcaaggccatcttctacctgctcatcatcgtcgggaccctgggccgccggctgaagcagtaccgcgagctcaagccccagacctgcaccatctgcgagacgacccccgtgaacgcgatcgacgccgagatgcacgacctgaactgcagctacaacatctgcccgtactgcgcctcccggctgaccagcgacgggctcgcccgccacgtgatccagtgccccaagcggaaggagaaggtcgaggagaccgagctgtacctgaacctcgagcgcatcccctgggtggtgcggaagctgctgcaggtctccgagagcacgggcgtggcgctcaagcgcagctcctggctgatcgtgctgctcgtcctgttcaccgtgagcctgtcccccgtgcagagcgccccgatcggccaggggaagaccatcgaggcctaccgggcccgcgagggctacacctccatctgcctcttcgtcctggggagcatcctgttcatcgtgtcctgcctcatgaagggcctggtggacagcgtcgggaactccttcttccccggcctgagcatctgcaagacgtgctccatcagctccatcaacggcttcgagatcgagagccacaagtgctactgctccctcttctgctgcccctactgccggcactgcagcaccgacaaggagatccacaagctgcacctgtccatctgcaagaagcgcaagaccgggagcaacgtgatgctcgccgtctgcaagctgatgtgcttccgcgcgaccatggaggtgtccaaccgggccctgttcatccgcagcatcatcaacacgaccttcgtgctgtgcatcctcatcctggccgtctgcgtggtgagcacctccgccgtcgagatggagaacctgcccgccggcacctgggagcgggaggaggacctcacgaacttctgccaccaggagtgccaggtgaccgagaccgagtgcctgtgcccgtacgaggcgctggtgctccgcaagcccctgttcctggacagcaccgccaaggggatgaagaacctcctgaactccacgagcctggagacctccctcagcatcgaggccccctggggcgccatcaacgtccagtccacctacaagcccaccgtgagcaccgccaacatcgcgctgtcctggagctccgtggagcaccgggggaacaagatcctggtcagcggccgctccgagagcatcatgaagctcgaggagcggacgggcatctcctgggacctgggggtggaggacgccagcgagtccaagctgctcaccgtgagcgtcatggacctgagccagatgtactccccggtgttcgagtacctgagcggcgaccgccaggtggaggagtggcccaaggccacctgcaccggggactgccccgagcggtgcggctgcacgtccagcacctgcctccacaaggagtggccccactcccgcaactggcggtgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacgcggttcaacctggggcccgtcaccatcaccctcagcgagccccgcaacatccagcagaagctgcccccggagatcatcaccctgcacccccggatcgaggagggcttcttcgacctcatgcacgtgcagaaggtgctgtccgcgagcacggtctgcaagctgcagtcctgcacccacggcgtgcccggggacctccaggtgtaccacatcggcaacctgctgaagggggacaaggtcaacggccacctcatccacaagatcgagccgcacttcaacaccagctggatgtcctgggacgggtgcgacctggactactactgcaacatgggcgactggcccagctgcacctacacgggcgtgacccagcacaaccacgcctccttcgtgaacctgctcaacatcgagaccgactacaccaagaacttccacttccacagcaagcgcgtcacggcccacggggacaccccccagctggacctgaaggcccggcccacctacggcgcgggggagatcaccgtgctcgtggaggtcgccgacatggagctgcacacgaagaagatcgagatctccggcctgaagttcgccagcctcgcctgcaccgggtgctacgcctgctccagcagcatctcctgcaaggtgcgcatccacgtggacgagccggacgagctgaccgtccacgtgaagagcgacgaccccgacgtggtcgcggcctccagctccctgatggcccggaagctcgagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctggagcagccccagtccatcctcatcgagcacaagggcacgatcatcgggaagcagaacagcacctgcaccgcgaaggcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcgcatcctcttctgcttcaagtgctgccggcgcacccggggcctgttcaagtaccgccacctgaaggacgacgaggagaccgggtaccggcgcatcatcgagaagctcaacaacaagaagggcaagaacaagctgctggacggggagcggctcgccgacggccgcatcgccgagctgttctccacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16986 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (opt1)
  source 1..3769: mol_type = other RNA
gggagaaagcttaccatggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctgcaggtgagcgagtccacgggggtcgccctcaagcggagcagctggctgatcgtgctgctcgtgctgttcaccgtctccctgagccccgtgcagtccgccccgatcggccaggggaagaccatcgaggcctaccgcgcgcgggagggctacaccagcatctgcctcttcgtgctgggctccatcctgttcatcgtcagctgcctcatgaaggggctggtggactccgtcggcaacagcttcttccccgggctgtccatctgcaagacgtgcagcatctccagcatcaacggcttcgagatcgagtcccacaagtgctactgcagcctcttctgctgcccctactgccgccactgctccaccgacaaggagatccacaagctgcacctgagcatctgcaagaagcgcaagaccgggtccaacgtgatgctcgccgtgtgcaagctgatgtgcttccgggccaccatggaggtcagcaaccgcgccctgttcatccggtccatcatcaacacgaccttcgtgctctgcatcctgatcctggccgtgtgcgtcgtgagcaccagcgcggtggagatggagaacctgcccgccggcacctgggagcgcgaggaggacctcacgaacttctgccaccaggagtgccaggtcaccgagaccgagtgcctgtgcccgtacgaggccctggtgctccggaagcccctgttcctggactccaccgccaagggcatgaagaacctcctgaacagcacgtccctggagaccagcctctccatcgaggccccctggggggcgatcaacgtgcagagcacctacaagcccaccgtctccaccgccaacatcgccctgagctggtccagcgtggagcaccgcggcaacaagatcctggtgtccgggcggagcgagtccatcatgaagctcgaggagcgcacgggcatcagctgggacctgggggtcgaggacgcctccgagagcaagctgctcaccgtgtccgtgatggacctgagccagatgtacagcccggtcttcgagtacctgtccggcgaccggcaggtggaggagtggcccaaggccacctgcaccggcgactgccccgagcgctgcgggtgcacgagctccacctgcctccacaaggagtggccccacagccggaactggcgctgcaacccgacctggtgctggggcgtggggaccggctgcacgtgctgcggcctggacgtcaaggacctgttcaccgactacatgttcgtgaagtggaaggtggagtacatcaagaccgaggcgatcgtctgcgtggagctcacctcccaggagcggcagtgcagcctgatcgaggccgggacgcgcttcaacctgggccccgtgaccatcaccctctccgagccccggaacatccagcagaagctgcccccggagatcatcaccctgcacccccgcatcgaggaggggttcttcgacctcatgcacgtccagaaggtgctgagcgcctccacggtgtgcaagctgcagagctgcacccacggcgtccccggggacctccaggtgtaccacatcggcaacctgctgaagggcgacaaggtgaacgggcacctcatccacaagatcgagccgcacttcaacacctcctggatgagctgggacggctgcgacctggactactactgcaacatgggggactggccctcctgcacctacacgggcgtcacccagcacaaccacgccagcttcgtgaacctgctcaacatcgagaccgactacaccaagaacttccacttccactccaagcgggtgacggcgcacggggacaccccccagctggacctgaaggcccgccccacctacggcgccggcgagatcaccgtcctcgtggaggtggccgacatggagctgcacacgaagaagatcgagatcagcgggctgaagttcgcctccctcgcgtgcaccggctgctacgcctgcagctccagcatcagctgcaaggtccggatccacgtggacgagccggacgagctgaccgtgcacgtcaagtccgacgaccccgacgtggtggccgccagctccagcctgatggcccgcaagctcgagttcgggaccgactccacgttcaaggcgttcagcgccatgcccaagacctccctgtgcttctacatcgtcgagcgcgagcactgcaagagctgctccgaggaggacaccaagaagtgcgtgaacaccaagctggagcagccccagagcatcctcatcgagcacaagggcacgatcatcgggaagcagaactccacctgcaccgccaaggccagctgctggctggagtccgtgaagagcttcttctacggcctgaagaacatgctctccggcatcttcgggaacgtcttcatgggcatcttcctgttcctggccccgttcatcctcctgatcctgttcttcatgttcgggtggcggatcctcttctgcttcaagtgctgccgccggacccgcggcctgttcaagtaccggcacctgaaggacgacgaggagaccgggtaccgccggatcatcgagaagctcaacaacaagaagggcaagaacaagctgctggacggcgagcgcctcgcggacgggcggatcgccgagctgttcagcacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16987 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (opt1)
  source 1..3190: mol_type = other RNA
gggagaaagcttaccatggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctgcaggtgagcgagtccacgggggtcgccctcaagcggagcagctggctgatcgtgctgctcgtgctgttcaccgtctccctgagccccgtgcagtccgccccgatcggccgcaagcccctcttcctggacagcaccgccaaggggatgaagaacctgctcaactccaccagcctggagacgtccctgagcatcgaggcgccctggggcgccatcaacgtgcagtccacctacaagcccaccgtcagcaccgccaacatcgccctctcctggagctccgtggagcaccggggcaacaagatcctggtcagcgggcgctccgagagcatcatgaagctggaggagcgcacgggcatctcctgggacctcggggtggaggacgccagcgagtccaagctgctgaccgtgagcgtcatggacctcagccagatgtactccccggtgttcgagtacctgagcggcgaccggcaggtggaggagtggcccaaggcgacctgcaccggggactgccccgagcgctgcggctgcacgtccagcacctgcctgcacaaggagtggccccactcccggaactggcgctgcaacccgacctggtgctggggcgtcgggaccggctgcacgtgctgcgggctggacgtgaaggacctcttcaccgactacatgttcgtgaagtggaaggtcgagtacatcaagaccgaggccatcgtgtgcgtggagctgaccagccaggagcggcagtgctccctgatcgaggccggcacccgcttcaacctcgggcccgtcacgatcaccctgagcgagccccggaacatccagcagaagctgcccccggagatcatcaccctccacccccgcatcgaggagggcttcttcgacctgatgcacgtgcagaaggtgctgtccgccagcaccgtctgcaagctccagtcctgcacgcacggcgtgcccggggacctgcaggtgtaccacatcggcaacctgctcaagggggacaaggtcaacggccacctgatccacaagatcgagccccacttcaacaccagctggatgtcctgggacggctgcgacctggactactactgcaacatgggggactggccgagctgcacctacaccggcgtgacgcagcacaaccacgcctccttcgtgaacctcctgaacatcgagaccgactacaccaagaacttccacttccacagcaagcgggtcaccgcgcacggggacacgccccagctggacctcaaggcccgccccacctacggcgccggggagatcaccgtgctggtggaggtcgccgacatggagctgcacaccaagaagatcgagatctccggcctcaagttcgccagcctggcgtgcacgggctgctacgcctgcagctccagcatctcctgcaaggtgcggatccacgtggacgagccggacgagctgaccgtccacgtgaagagcgacgaccccgacgtggtcgccgcctccagctccctcatggcgcgcaagctggagttcgggaccgacagcaccttcaaggccttctccgccatgcccaagacgagcctgtgcttctacatcgtggagcgggagcactgcaagtcctgcagcgaggaggacaccaagaagtgcgtgaacaccaagctcgagcagccccagtccatcctgatcgagcacaagggcaccatcatcgggaagcagaacagcacgtgcaccgccaaggcctcctgctggctggagagcgtcaagtccttcttctacggcctcaagaacatgctgagcgggatcttcggcaacgtgttcatgggcatcttcctgttcctcgcgccgttcatcctgctgatcctcttcttcatgttcgggtggcgcatcctgttctgcttcaagtgctgccggcgcacccggggcctgttcaagtaccgccacctcaaggacgacgaggagaccgggtaccggcgcatcatcgagaagctgaacaacaagaagggcaagaacaagctgctcgacggggagcgcctggccgacggccggatcgccgagctgttctccacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16988 - RNA, 1246 nt, synthetic construct
  misc_feature 1..1246: note = mRNA product Design1 comprising derived and/or modified sequence from CCHVF(10200)__U39455.2__IgE-leader_Gn (opt1)
  source 1..1246: mol_type = other RNA
gggagaaagcttaccatggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctccaggtgagcgagtccacgggggtcgccctgaagcggagcagctggctgatcgtgctgctcgtgctgttcaccgtctccctgagccccgtgcagtccgccccgatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16989 - RNA, 2206 nt, synthetic construct
  misc_feature 1..2206: note = mRNA product Design1 comprising derived and/or modified sequence from CCHVF(10200)__U39455.2__IgE-leader_Gc (opt1)
  source 1..2206: mol_type = other RNA
gggagaaagcttaccatggactggacctggatcctgttcctcgtggccgccgcgacccgcgtccacagcttcctggactccacggccaagggcatgaagaacctgctcaacagcacctccctggagaccagcctgtccatcgaggccccctggggcgccatcaacgtgcagagcacctacaagccgacggtgtccaccgccaacatcgcgctcagctggtccagcgtcgagcaccgggggaacaagatcctggtgtccgggcgcagcgagtccatcatgaagctggaggagcggaccggcatcagctgggacctcggggtggaggacgcctccgagagcaagctgctgaccgtctccgtgatggacctcagccagatgtactcccccgtgttcgagtacctgagcggcgaccgccaggtcgaggagtggcccaaggccacgtgcaccggcgactgccccgagcggtgcgggtgcaccagctccacgtgcctgcacaaggagtggccgcacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcgccagtgcagcctcatcgaggcgggcacccggttcaacctgggccccgtgaccatcacgctgtccgagccccgcaacatccagcagaagctcccgcccgagatcatcaccctgcacccccggatcgaggaggggttcttcgacctgatgcacgtgcagaaggtcctcagcgcctccaccgtgtgcaagctgcagagctgcacccacggcgtgcccggggacctgcaggtctaccacatcggcaacctcctgaagggcgacaaggtgaacgggcacctgatccacaagatcgagccgcacttcaacacgtcctggatgagctgggacggctgcgacctcgactactactgcaacatgggggactggccctcctgcacctacaccggcgtgacccagcacaaccacgccagcttcgtcaacctgctgaacatcgagacggactacaccaagaacttccacttccactccaagcgcgtgaccgcccacggggacacgccccagctcgacctgaaggcccggcccacctacggcgcgggcgagatcaccgtcctggtggaggtggccgacatggagctccacaccaagaagatcgagatcagcgggctgaagttcgcctccctggcctgcaccggctgctacgcctgcagctccagcatctcctgcaaggtccgcatccacgtggacgagccggacgagctcacggtgcacgtcaagagcgacgaccccgacgtggtggcggccagctccagcctgatggcccggaagctggagttcgggaccgactccaccttcaaggccttcagcgccatgcccaagacctccctctgcttctacatcgtcgagcgcgagcactgcaagagctgctccgaggaggacaccaagaagtgcgtgaacacgaagctggagcagccccagagcatcctgatcgagcacaagggcaccatcatcgggaagcagaactccacgtgcaccgcgaaggccagctgctggctcgagtccgtcaagagcttcttctacggcctgaagaacatgctgtccggcatcttcgggaacgtgttcatgggcatcttcctcttcctggccccgttcatcctgctgatcctcttcttcatgttcgggtggcggatcctgttctgcttcaagtgctgccgccggacccgcggcctgttcaagtaccggcacctcaaggacgacgaggagaccgggtaccgccgcatcatcgagaagctgaacaacaagaagggcaagaacaagctgctcgacggcgagcggctggccgacgggcgcatcgccgagctgttcagcaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16990 - RNA, 1666 nt, synthetic construct
  misc_feature 1..1666: note = mRNA product Design1 comprising derived and/or modified sequence from CCHFV(10200)__NC_005302.1/U88410.1__N (opt5)
  source 1..1666: mol_type = other RNA
gggagaaagcttaccatggagaacaagatcgaagtgaataacaaagacgagatgaatagatggttcgaagagtttaagaaaggcaacgggctggtcgataccttcacaaatagctactccttttgcgaatctgttcccaacctcgaccggttcgtgtttcagatggccagcgctacggatgacgcccaaaaggattccatttatgcgtctgctctggtggaggccaccaaattctgtgcccctatctacgagtgcgcttgggtcagctccacaggaattgtgaagaagggccttgaatggtttgagaaaaatgccgggaccatcaagtcttgggacgaaagctatacagagctgaaagttgatgtgccgaagattgagcagctcaccggataccagcaggctgccctgaaatggcgcaaggacatcggcttcagagtcaacgcgaatacagccgctctttccaacaaggtgctggccgaatataaagttcccggggagatcgtgatgagcgtcaaggaaatgctctctgatatgattcggcgcagaaatctgatcctgaaccggggaggcgacgagaatcctcgcggccccgtgtcccacgaacacgtggattggtgtagagagtttgtcaaagggaagtacattatggctttcaaccctccctggggagacatcaataaaagcggccggtctgggattgccctcgttgcgaccggactggccaaacttgctgagacggaaggcaaagggatctttgatgaggccaagaagaccgtggaagctctgaacggatatctcgacaaacacaaggacgaggtggatcgcgcctccgccgacagcatgattacaaacctgcttaaacatatcgctaaggcgcaagaactgtacaaaaattcttccgccctcagagctcagagcgcccagatcgataccgccttctcctcttactattggctgtacaaggctggcgtcacacctgagacctttccgacggtgagccagttcctgttcgagctcggcaagcaaccccgggggacaaagaagatgaaaaaggccctgctttccacccctatgaaatggggaaagaagctgtatgaactctttgcggacgatagcttccagcagaaccgcatttacatgcaccccgctgttctgacagccggcagaatctctgagatgggggtgtgctttggaaccattcctgtcgccaatcccgacgatgctgcccagggctccgggcataccaaaagcatccttaacctgcggacaaatacggaaaccaacaatccgtgtgctaagacaattgtgaaactcttcgaggttcaaaagaccggatttaacatccaggacatggatatcgtggcctctgaacatctgctgcaccagagcctcgtcggcaaacaatcccctttccagaatgcgtataacgtgaagggcaatgccacatctgctaacattatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16991 - RNA, 1666 nt, synthetic construct
  misc_feature 1..1666: note = mRNA product Design1 comprising derived and/or modified sequence from CCHFV(Turkey-Kelkit06)__GQ337053.1__N (opt5)
  source 1..1666: mol_type = other RNA
gggagaaagcttaccatggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaagactctgggaccatcaagagctgggatgaaaattatgccgagctgaaagtggacgttccgaagattgagcagctcgctaactaccagcaggccgcgctgaagtggagaaaagatatcggattccgggtgaatgccaacacagctgccctttccaataaggtcctggctgaatataaagtgcccggcgagatcgttatgagcgtgaaggaaatgctctctgacatgattcgcagacggaacctgatcctgaatcgcgggggagatgagaaccctagaggccccgtctcccgggaacacgtggagtggtgtcgcgagtttgtgaaaggcaagtacattatggccttcaatcctccctggggagacatcaacaaaagcgggagatctggcattgcgctcgtcgccaccgggctggctaaacttgccgaaacagagggaaagggcgtttttgatgaagctaagaagaccgtggaggccctgaacgggtatctcgacaaacatcgggacgaagtggataaggcctccgctgacagcatgatcacgaatctgcctaaacacattgcgaaggcccaagagctttacaagaactcttccgctctgcgcgcccagggagcccagatcgataccccgttcagctccttttactggctctataaagctggcgtcacacccgagaccttccctacaatctctcagttcctgtttgaactgggcgagcaacccagagggaccaagaaaatgaagaaagccctcctgagcacgcctatgaagtggggaaagaaactttacgaactgttcgcggacgattcctttcagcagaatcggatttatatgcatcccgctgtgctcacagccggccgcatcagcgagatgggggtttgcttcggaaccattccggtggccaaccctgacgatgctgcccagggctctgggcacacaaagtccatcctgaatcttagaaccagcaccgaaacaaacaatccctgtgctaaaacgattgtcaagctgtttgagatccaagagaccggattcaacatccaggacatggatattgtggcctctgaacatctcctgcaccagagcatcgttggcaaacaatccccttttcagaatgcgtacaacgtgaagggcaatgccacatctgctaacattatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16992 - RNA, 5272 nt, synthetic construct
  misc_feature 1..5272: note = mRNA product Design1 comprising derived and/or modified sequence from CCHFV(10200)__U39455.2__GP (opt5)
  source 1..5272: mol_type = other RNA
gggagaaagcttaccatgcacatcagcctgatgtacgccattctctgcctgcagctttgtggcctgggggagacccatggatcccacaacgaaacaagacataataagacggacaccatgacaacccacggcgataacccctctagcgagcctccggtgtccacagctctctctatcaccctggaccccagcacagtcacccctacgacccccgcctccgggcttgaaggatctggcgaggtttatacaagccctcccattaccacagggtccctgcctctcagcgaaaccacgccggagctgcccgtgacaaccggaacagataccctgtctgcgggcgacgtggatccttccacccagacagctggcgggacgagcgcccccaccgtccggacatctctccctaattcccccagcaccccgtctacacctcaggacacccatcaccccgtgcgcaacctgctttccgttacgagccctggacccgatgagacatccaccccctctggcaccgggaaagaaagctccgccacaagctctcctcacccggtgtccaatagaccccctacaccccctgctaccgcccagggacccacggagaacgacagccataatgctaccgaacacccggagtctctgacacagagcgccacccctggcctcatgacatcccccacccaaatcgtccatcctcagtctgcgacgcccattaccgtgcaggatacacaccctagccccaccaaccggtccaagcgcaatctgaaaatggagatcatccttacactgagccaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacaccgggcaccctctctaccacagagtccacgcctgccgggctgcccaccgctgaacccttcaagagctactttgccaaaggattcctgtctatcgactccggctattacagcgctaagtgctattccgggacatctaacagcggactccagctgattaatatcacccggcattccacacgcattgtggacacccctggcccgaaaatcacgaaccttaagacaatcaattgtattaacctgaaggcctctatctttaaagagcacagagaagtcgagattaacgtgctcctgccccaagtggcggtcaatcttagcaactgccatgttgtgatcaagtcccacgtgtgtgattacagcctggacattgatggcgccgtccggctccctcatatctaccacgagggggtgttcatccccggaacctataaaattgttatcgacaagaaaaataagctgaacgatcgctgcaccctgtttacagactgtgtgattaaaggcagagaagtccggaaggggcagtctgtgctccgccagtacaagaccgagatcagaattggaaaggcttccacaggcttccggagactgcttagcgaggaaccttctgatgactgcgtttcccgcacgcaactgctccggaccgaaacagccgagatccacggggataattatggcggacccggcgacaagatcaccatttgtaacgggagcacaatcgtggatcagagactgggatctgagctgggctgctacaccattaatcgcgtccggagctttaaactttgcgaaaactccgctacggggaagaattgtgagatcgacagcgtgcctgtcaaatgcagacagggatattgtctccgcattacccaggaaggccgggggcatgtgaagctgtctagaggctccgaggttgtgctggacgcctgcgatacaagctgtgagatcatgattcccaagggaaccggcgacatcctcgtcgattgctccgggggacaacagcacttcctgaaagacaaccttatcgatctgggctgtccgaagattcctctcctggggaaaatggccatctacatttgccgcatgtctaatcatcccaagacaaccatggctttcctgttttggttcagctttggatatgtgatcacatgtattctttgcaaagcgatcttctacctcctgatcattgttggcaccctggggcggagactcaagcagtaccgcgaactgaagcctcagacgtgtacaatctgcgagaccacccccgtgaacgccattgacgctgaaatgcacgatcttaattgctcctataacatctgtccgtactgcgcctctcggctgacaagcgacggcctcgccagacacgtcattcaatgtcctaaacggaaggagaaagtggaagagaccgagctgtatctgaatcttgaacgcatcccctgggtggttagaaagctcctgcaggtctccgagtctacgggagtggctctgaaacggagctcctggctcatcgtgctgcttgtcctgtttacagtgagcctctctcctgttcagtccgcccccattggccaggggaagaccatcgaagcgtacagagctcgcgagggatatacaagcatttgcctgttcgtgctgggctctatcctttttattgtctcctgtctcatgaaggggctggtggatagcgttggaaactctttctttcccggcctgtccatctgcaaaacctgtagcatctccagcattaacgggttcgaaatcgagtctcataagtgctactgtagcctcttttgctgtccttattgccggcactgctccacagacaaagagattcataagctgcacctttctatctgtaaaaagagaaaaaccggcagcaatgtgatgctggccgtctgcaagctcatgtgtttccgcgccacgatggaagtgtccaacagagctctgtttattcggtctatcattaataccacattcgttctgtgcatccttatcctggccgtgtgtgtcgtgagcacctccgctgtggagatggaaaacctcccggccggaacatgggagcgcgaagaggatctgaccaatttctgccatcaagagtgtcaggtcacggaaacagagtgcctctgtccctacgaagcgctggttcttagaaagcctctgtttctcgactctaccgccaaaggcatgaagaacctgctgaatagcacatcccttgagaccagcctgtctattgaggctccctggggagccatcaacgtgcagtccacctacaaacctacagtgagcacggctaatattgccctctcttggtccagcgtcgaacaccggggaaacaagatcctggtgtccggccgctctgagagcattatgaaactcgaagagagaaccgggatctcctgggatctgggagttgaagacgcgagcgagtctaaacttctgacagtgtccgtcatggacctcagccagatgtattctcccgtgttcgagtacctgagcggcgatcggcaagttgaagagtggcctaaggctacctgcacaggcgactgtccggaacgctgcgggtgcacctcctctacgtgtctgcacaaagagtggccccatagcagaaattggcggtgcaaccctacatggtgttggggagtgggcaccgggtgcacctgttgcggacttgatgtcaaggacctgtttacagattatatgttcgtgaaatggaaggttgaatacatcaaaaccgaggccattgtgtgtgtcgagctcacatcccaggaacgccagtgctctctgatcgaggccggcacgagatttaatctcgggcccgtgaccattacactgagcgaacctcggaacatccaacagaaacttcccccggagattatcaccctgcaccctagaatcgaagagggattctttgacctgatgcatgtgcagaaggtcctctccgctagcacagtttgtaaactgcagtcttgcacccacggcgtgcccggcgatcttcaagtgtatcatattgggaatctgctcaagggagacaaagtcaacggccacctgatccacaagattgagccccatttcaacacgtcctggatgagctgggatgggtgtgacctcgattactattgcaatatgggagactggccttcctgcacctacacaggcgtgacccagcacaaccatgcctcttttgttaatctgcttaacatcgaaacagattacaccaaaaatttccactttcacagcaagcgcgtgacagcccatggggacacgccccagctggacctgaaggctcggcctacctatggagcgggcgagattacagtcctcgtggaagttgccgatatggagctgcacaccaaaaagatcgagatttccggccttaaattcgcttctctggcctgtaccgggtgctacgcctgtagctccagcatctcttgcaaggtgagaatccatgtcgacgaaccggatgagctcacagtgcacgtcaaatccgacgatcccgacgtggttgctgcctctagctccctgatggcgcgcaagctcgaatttggaacggatagcaccttcaaggctttctctgccatgcctaagacaagcctgtgtttttatattgtggagcgggaacattgcaagtcctgttctgaggaggacaccaaaaagtgcgtcaacacaaaacttgaacagccccaaagcatcctgattgagcacaagggcaccatcattgggaaacaaaattccacgtgtacagccaaggctagctgctggctggaatccgtgaagtctttcttttacggactcaaaaacatgctgagcggcatcttcgggaatgtttttatgggaatcttcctttttctggcccctttcattctcctgatcctctttttcatgtttggctggcgcattctgttctgtttcaagtgctgcagacggaccagaggcctttttaaatatcgccacctgaaggatgacgaggaaaccgggtaccggagaatcattgagaaactgaacaataagaaggggaaaaacaagctcctggatggcgagcggcttgcggacgggcgcatcgctgaactgttctccacaaaaacccatatcggatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16993 - RNA, 5272 nt, synthetic construct
  misc_feature 1..5272: note = mRNA product Design1 comprising derived and/or modified sequence from CCHFV(IbAr10200)__AF467768.2__GP (opt5)
  source 1..5272: mol_type = other RNA
gggagaaagcttaccatgcacatcagcctgatgtacgccattctctgcctgcagctttgtggcctgggggagacccatggatcccacaacgaaacaagacataataagacggacaccatgacaacccccggcgataacccttctagcgagccgcccgtgtccacagctctctctatcaccctggaccctagcacagtcacccccacgacccctgcctccgggcttgaaggatctggcgaggtttatacatctccccctattaccacagggtccctgccgctcagcgaaaccacgcccgagctgcctgtgacaaccggaacagataccctgtctgcgggcgacgtggatccctccacccagacagctggcgggacgagcgcccctaccgtccggacatctctccccaattccccgagcaccccttctacaccccaggacacccaccatcctgtgcgcaacctgctttccgttacgagccccggacccgatgagacatccaccccttctggcaccgggaaagaaagctccgccacaagctctccgcaccccgtgtccaatagacctcccacccctcccgctacagcccagggaccgacggagaacgacagccacaatgctaccgaacatcctgagtctctgacacagagcgccacccccggcctcatgacatcccctacccaaatcgtccacccccagtctgcgacgcctattaccgtgcaggatacacatcccagcccgaccaaccggtccaagcgcaatctgaaaatggagatcatccttacactgagccaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacacctggcaccctctctaccacagagtccacgcccgccgggctgcccaccgctgaacctttcaagagctactttgccaaaggattcctgtctatcgactccggctattacagcgctaagtgctattccgggacatctaacagcggactccagctgattaatatcacccggcactccacacgcattgtggacaccccgggccccaaaatcacgaaccttaagacaatcaattgtattaacctgaaggcctctatctttaaagagcatagagaagtcgagattaacgtgctcctgcctcaagtggcggtcaatcttagcaactgccacgttgtgatcaagtcccatgtgtgtgattacagcctggacattgatggcgccgtccggctcccccacatctaccatgagggggtgttcatccctggaacctataaaattgttatcgacaagaaaaataagctgaacgatcgctgcaccctgtttacagactgtgtgattaaaggcagagaagtccggaaggggcagtctgtgctccgccagtacaagaccgagatcagaattggaaaggcttccacaggcagccggagactgctttctgaggaaccctccgatgactgcatcagccgcacgcaactgctccggaccgaaacagccgagatccacggggataattatggcggacctggcgacaaaattaccatctgtaacgggtctacaattgttgatcagagactgggaagcgagctgggctgctacaccatcaatcgcgtgcggtccttcaaactttgcgaaaacagcgctacggggaagaattgtgagattgactctgtccccgtgaaatgcagacagggatattgtctccgcatcacccaggaaggccgggggcacgtcaagctgtccagaggcagcgaggtggttctggacgcctgcgatacatcctgtgagattatgatcccgaagggaaccggcgacatcctcgtggattgctctgggggacaacagcattttctgaaagacaaccttattgatctgggctgtcctaagatccccctcctggggaaaatggccatttacatctgccgcatgagcaatcaccctaagacaaccatggctttcctgttctggttttccttcggatatgtcattacatgtatcctttgcaaagcgatcttttacctcctgattatcgtgggcaccctggggaagcggctcaagcagtacagagaactgaaaccccagacgtgtacaatttgcgagaccaccccggttaacgccatcgacgctgaaatgcatgatcttaattgctcttataacatttgtccttactgcgccagccgcctgacatccgacggcctcgcccggcacgtgatccaatgtcccaagagaaaagagaaggtcgaagagaccgagctgtatctgaatcttgaacggatcccttgggtggtgcgcaaactcctgcaggtttctgagagcacgggagtcgctctgaagagatccagctggctcattgtgctgcttgtgctgttcacagtctctctctcccccgtgcagagcgcccccatcggccaggggaagaccattgaagcgtaccgggctagagagggatatacatctatctgcctgtttgttctgggctccattcttttcatcgtgagctgtctcatgaaagggctggtcgattctgtgggaaactcctttttccctggcctgagcatctgcaagacctgttccattagctctatcaacgggtttgaaattgagagccacaaatgctactgttccctcttctgctgtccgtattgccgccattgctctacagacaaggagatccacaaactgcatcttagcatttgtaagaaacggaagaagggctccaatgttatgctggccgtgtgcaaactcatgtgttttagagccaccatggaagtctctaaccgcgctctgttcatcagaagcattatcaatacgacctttgtgctgtgcatccttattctggccgtttgtgtggtctccacatctgctgtggagatggaaaacctccccgccggaacctgggagcgggaagaggatctgacaaatttctgccaccaagagtgtcaggtgaccgaaacggagtgcctctgtccttacgaagcgctggtccttcgcaagcccctgttcctcgacagcacagccaaaggcatgaagaacctgcttaattccaccagcctggagacatctctgtccatcgaggctccttggggagccattaacgttcagagcacctacaaacccaccgtgtctacagctaatatcgccctctcctggagctccgtggaacatagagggaacaagattctggtctctggccggagcgagtccatcatgaagctcgaggaacgcacggggatcagctgggatctgggagtggaagacgcgtctgagtccaaacttctgaccgttagcgtgatggacctctctcagatgtatagccctgtctttgagtacctgtccggcgatagacaagtgggcgaatggccgaaggccacatgcaccggggactgtcccgagcggtgcggatgcacatctagcacctgtctgcacaaagaatggcctcactcccgcaattggagatgcaaccccacgtggtgttggggcgttgggacaggatgcacctgttgcggccttgatgtgaaggacctgttcaccgattatatgtttgtcaaatggaaggtggagtacattaagacagaagctatcgtttgtgtggagctcacctctcaggagcggcagtgcagcctgattgaagccgggacacgcttcaatctcggacctgtcacgatcaccctgtccgagcccagaaacattcaacagaaacttccgcctgaaatcatcacactgcatccccggattgaggaaggctttttcgacctgatgcacgtgcagaaggtgctcagcgcttctaccgtctgtaaactgcagtcctgcacacatggcgttcccggggatcttcaagtgtatcacatcggaaatctgctcaagggcgacaaagtgaacgggcatctgattcacaagatcgagcctcactttaacaccagctggatgtcctgggatggatgtgacctcgattactattgcaatatgggcgactggccctcttgcacgtacaccggggtcacacagcataaccacgccagcttcgtgaatctgcttaacattgagaccgattacacaaagaattttcatttccactccaaaagagttaccgcccacggagacacacctcagctggacctgaaggctcgcccgacgtatggcgcgggcgaaatcaccgtgctcgtcgaggtggccgatatggaactgcataccaaaaagattgagatctctgggcttaaatttgctagcctggcctgtacaggatgctacgcctgttccagcggcatctcttgcaaggttcggattcacgtggacgagcccgatgaactcaccgtccatgtgaaatccgacgatcctgacgtcgtggctgcctctagctccctgatggcgagaaagctcgagttcgggacagatagcacgtttaaggctttctctgccatgcccaaaaccagcctgtgtttctatatcgttgaacgcgagcactgcaagtcctgttctgaagaggacaccaaaaagtgcgtgaacacaaaacttgagcagcctcaaagcattctgatcgaacataagggaacaattatcggcaagcaaaattccacctgtacggccaaagctagctgctggctggagtccgtcaagagctttttctacgggctcaaaaacatgctgagcggaatctttggcaatgtgttcatgggcatttttcttttcctggccccctttatcctcctgattctcttctttatgttcgggtggcggatcctgttttgtttcaagtgctgcagacgcacacggggacttttcaaatatagacacctgaaggatgacgaagagaccggctaccgccggattatcgaaaagctgaacaataaaaaggggaaaaacaagctcctggatggagagagacttgcggaccggcgcatcgctgagctgttttccaccaaaacacacattggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16994 - RNA, 5284 nt, synthetic construct
  misc_feature 1..5284: note = mRNA product Design1 comprising derived and/or modified sequence from CCHFV(Turkey-Kelkit06)__GQ337054.1__GP (opt5)
  source 1..5284: mol_type = other RNA
gggagaaagcttaccatgcccaccaacatcatgcacacacctctggtgtgcttcattctctacctgcagcttctgtgtctcggcggggcccatggacaactgaatgctacggagcacaacggcaccaataacacaaccgccccgggggcgagccagtcccccaagcctcccatgtctacaacccctccccatgctcctgaaagctccacaatcaaaccgaccacgcccatttctgaggccgaaggaagcggcgagaccacatcccctcccaataccacacaggggctttctagccctgaaaccacgtccgagagacccgccacaaccagcatctctacatccagcaccgactctaccaacccgacaacgcagatgaccgataatacacctacccccacagtctccaccagcccttcttccagcccctccacgccctctacacctcaagggattcaccatccggctcggagcctgctctccgttagctctcccaagaccgtgaccacacctacccccacatcccctggcgagatgagctctgaaacgagctcccagcactctgccatgagccgcatccccaccccgcacacagctaccagagtgtccacagagatcaccaaccatcggacgcctcgccagagcgaatcttccgcccagcaaaccacacccagccctatgacctctcccgcgcagtccattctgctgatgagcgccgctcctacagccgtccaggacatccacccctccccgaccaatagatctaaacggaacctcgagacggagattatcctgacacttagccagggcctgaagaaatattacgggaagattctcaagctgcttcatctgaccctcgaacaagatacagagggactgctggaatggtgcaaaggcaatctcgggtccaactgtgacgatgactttttccagaagcgcatcgaggaatttttcatgaccggagagtgctattttaatgaggtgctgcagttcaaaaccctttctacactgagccctacggaaccctcccacgctagactccccaccgccgagccttttaagagctacttcgcgaaaggctttctgtctattgattccgggtatttcagcgccaagtgttacccgcggtcttccgctagcggacttcaactgatcaacgttacacagcaccccgcccgcatcgctgaaacccctggccccaagacaacctctctcaaaacgattaattgcatcaacctgagagccagcgtgtttaaggagcatcgggaagtcgagattaacgtgctgctccctcagatcgccgttaatctgtccaactgtcacgtggtcattaatagccatgtgtgcgactattctcttgatacagacggccccgtgcgcctgcctagaatctaccacgaggggaccttcatccccggaacctacaaaattgtcatcgataagaaaaacaagctcaatgaccggtgtacactggttaccaactgcgtgattaaaggccgcgaagtgagaaaggggcagtccgtccttcggcaatataagacagagatcaaaattggaaaggctagcacgggctttagaaaactgctctccgaggaaccgggggatgactgtatctctcgcacccagctgctgcggacagaaaccgcggagatccatgacgataattacggaggccctggcgacaagattacaatctgcaacgggagcaccattgtggatcagagactcggatccgagctgggctgctatacgatcaatcgcgttaaatctttcaaactttgtaagaacagcgccaccgggaagacatgcgaagtggactccacccccgtcaagtgtcggcagggattctgcctgaaaattacacaagagggcagagggcacgtgaagctctctcgcggcagcgaagttgtgctggatgcttgtgactccagctgcgaggtcatgatccctaaaggaaccggcgatattctggtggactgttctgggggacagcagcactttcttaaggataatctcatcgacctgggctgcccccatatcccgctgctcgggcggatggccatttacatctgtagaatgtccaaccaccctcgcacaaccatggccttcctgttttggttcagctttggatatgtcattacgtgcatcttctgtaaggctctgttttactctctgattatcatcggcacactcgggaaaaagattaaacagtatcgggagctgaagccccaaacctgcaccatctgcgaaacagcccctgtgaatgcgattgatgctgagatgcatgacctgaactgttcctacaatatctgcccctactgtgccagcagacttacctctgacggcctcgcccgccacgttacgcagtgccccaaacggaaggaaaaggtggaggaaacagagctgtatctgaacctcgagcggattccttggatcgtcagaaaactgcttcaggtgtccgaaagcaccggagttgctctgaagcgctccagctggctcatcgtgctgctggtccttctcacagtgtctctgagcccggtgcagtccgcccccgttggccacgggaaaaccattgagatctaccaaacaagagaaggattcgcttctatttgtctgtttatgctcggcagcatcctgttcattgtctcctgccttgtgaaggggctggtggattctgtcagcgagtcctttttccctggactctctgtgtgtaaaacctgcagcatcggctccgttaacgggtttgaaatcgagagccataagtgttattgctctctgttctgttgcccctactgccggcactgttccgccgacagagagattcatcagctgcaccttagcatctgcaaaaagcgcaagacgggctctaatgtgatgctcgcggtctgtaaacggatgtgcttcagagccaccattgaggcttcccgcagagccctgctgatccggagcattatcaacacaacctttgtgatttgtatcctcacactgaccatctgcgttgtgtccacgtctgctgtcgaaatggaaaatcttcctgccggaacatgggagcgcgaagaggatctgaccaacttctgtcatcaggagtgccaagtgacagaaaccgagtgtctctgcccctatgaagcgctggttctgagaaagcctctttttctggacagcattgtgaaaggcatgaagaatctcctgaactccaccagcctcgagacatctctgtccatcgaggccccgtggggagctattaatgtccagagcacgttcaaacccaccgtgtctacagccaacatcgctcttagctggtcctctgtggtccaccggggaaataagattctggttaccggccgcagcgaatccatcatgaagctcgaggaaagaacaggggtgtcttgggatctgggagtggaggacgccagcgaatccaaactgcttaccgtcagcatcatggatctgtctcagatgtactcccctgtgtttgagtatctcagcggcgaccggcaggttgaggaatggcccaaggccacgtgtacaggggattgccctgagcgctgcggctgtacctcctctacctgcctgcacaaagaatggagccattccagaaactggcggtgtaatcccacatggtgctggggagtgggcaccgggtgtacatgctgtggagtcgacgtgaaggatctcttcacggaccacatgtttgttaaatggaaggtggagtacattaagaccgaagctatcgtctgcgtggcgctgacatctcaagagcgccagtgtagccttattgaggccggcaccagattcaacctggggccggttacaatcaccctctccgaacctcggaatattcagcagaaactgcctcccgagatcatcacgctgcatcccaagattgaagagggatttttcgatcttatgcacgtgcaaaaagtcctgagcgcttctaccgtgtgcaagctccagtcctgtacacatggcatccccggcgaccttcaggtgtaccacattgggaacctcctgaaaggagacagagtcaatggccaccttatccataagattgaaagccactttaacacctcttggatgtcctgggatgggtgcgacctggattattactgcaacatgggagactggcctagctgtacatataccggcgttacacagcataatcacgccgccttcgtgaacctgctcaatatcgagacggattacaccaagacatttcacttccattctaaacgcgtgaccgctcacggggacaccccgcaactggatcttaaggcccggcccacatatggagcgggcggcattacggtcctggtggaggttgctgacatggaactccataccaaaaaggtggagatcagcgggctgaaattcgcctccctcgcctgcacaggatgttacgcttgctctagcggcatctcctgtaaggtccgcattcacgtggatgaacctgacgagctgaccgttcatgtgaaaagctccgatcccgacgtcgtggccgcgtctacaagccttatggctagaaagctggagtttgggaccgattccacgttcaaggccttttctgccatgcctaaaacaagcctgtgcttctatatcgtcgaacgggagtactgtaagtcctgctctgaagacgacacccagaaatgtgtggataccagactcgagcagccccaaagcattctgatcgaacacaagggaacaattatcggcaaacagaacgatacctgcacagctaaggcctcctgttggcttgagagcgttaagtcctttttctacgggctgaaaaatatgctcggatctgtgtttggcaacctgttcatcggcattctcctgtttcttgctccgttcgtcctgctggtgctctttttcatgttcgggtggaagatcctgttttgcttcaaatgctgtcgccggaccagaggactttttaagtatcgccacctgaaagacgacgaggaaacgggctaccggagaattatcgagcggctcaatagcaagaaggggaaaaaccgcctgctcgatggagacagactggccgatcggaagattgcggaacttttctctacaaaaacccatatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16995 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (opt5)
  source 1..3796: mol_type = other RNA
gggagaaagcttaccatgcacatcagcctgatgtacgccattctctgcctgcagctttgtggcctgggggagacccatggatcccacaacgaaacatctgaggaacccagcgacgattgcgtgtccagaacgcagctcctgcggaccgagacagctgaaatccatggcgacaattatgggggacctggcgataagattaccatctgtaacgggtctacaattgtcgaccagcgccttggaagcgagctgggctgctacaccatcaatagagttcggtccttcaaactctgtgagaactctgccacaggcaagaattgcgaaatcgatagcgtgccggtgaaatgtcgccaggggtattgcctgagaattacccaggagggacggggccacgtcaagctgtcccgcgggagcgaagtggttctcgacgcgtgtgatacgtcttgcgagatcatgattcccaaaggaaccggcgacatcctggtggattgttccgggggacaacagcattttcttaaggacaacctgattgatctcggctgccctaagatccccctgcttggcaaaatggctatttacatctgcagaatgagcaatcaccctaagacaaccatggccttcctgttttggttctcttttgggtatgtcatcacatgtattctctgcaaagccatcttctacctgctgattatcgtgggaaccctcggccggcgcctgaagcagtatagagagcttaaaccccagacgtgtacaatttgcgaaaccacacctgttaacgctatcgacgccgagatgcacgatctgaattgttcctacaacatctgcccgtactgtgctagccggctcacctctgacgggctggcccgccatgtgattcaatgccccaagagaaaggaaaaagtcgaggaaaccgagctttatctgaatctcgagcggatcccttgggtggtgcgcaagctgctgcaggtctccgaaagcacaggagttgcgctcaaaagatcctcttggctgattgtgcttctggtgctctttacggtcagcctgtcccccgtgcagagcgcccctatcggccaggggaagaccattgaggcttaccgggccagagaaggatatacatctatctgtcttttcgttctgggctccatcctctttattgtgagctgcctgatgaaaggcctggtcgactctgtggggaacagcttctttcccggactctccatctgtaagacctgctctattagctccatcaatggcttcgagattgaaagccacaaatgctactgttctctgttttgctgtccgtattgccgccattgttccacagataaggagatccacaagctccacctgagcatttgcaaaaagcggaaaaccgggtctaacgttatgctcgctgtgtgtaagctgatgtgcttcagagccacgatggaggtctccaatcgcgcgctgttcatccggagcatcattaacacaacctttgtgctttgtatcctcattctggccgtctgcgtggtttccacctctgctgtggaaatggagaacctgcctgccggaacatgggaaagagaggaagacctcaccaatttctgtcatcaagagtgccaggtcacagagacggaatgcctgtgtccctacgaggctcttgtgctgcgcaaacctctctttctggatagcaccgccaagggcatgaagaacctgcttaattccacatctctcgaaaccagcctgtccatcgaggccccctggggcgctattaacgttcagagcacatataaacccaccgtgtctacggcgaatatcgccctgtcctggagctctgtcgagcaccgggggaacaagatcctcgtgtccggaagaagcgaatctattatgaaactggaggaacgcaccggcatcagctgggaccttggggtggaggatgcttccgaaagcaagctgctcacagtttctgtcatggacctgtcccaaatgtacagccctgtgttcgagtacctgtccggagatagacaggtggaggaatggccgaaagctacctgcacaggcgactgtcccgagcggtgcgggtgtacctctagcacgtgccttcataaggaatggcctcactcccgcaattggcggtgtaaccccacatggtgctggggagtcggcaccgggtgtacatgctgtggcctcgatgtgaaggacctgtttaccgattatatgttcgttaaatggaaggtggagtacattaaaaccgaagccatcgtctgcgtggagctgacatctcaggagagacagtgcagcctcattgaagccggaacgcggtttaatctgggccctgttaccatcacactttccgagccccgcaacatccaacagaagctgccgcctgaaattatcaccctccatcccagaattgaggaagggttctttgacctgatgcacgtgcagaaagtcctgtctgccagcacagtgtgtaaacttcagtcctgcacccacggagttcctggcgacctccaagtgtatcatatcgggaatctgctgaagggagataaagtcaacggccacctcattcataagatcgagccccacttcaatacgagctggatgtcttgggacgggtgtgatctggactactattgcaacatgggcgattggccttcctgtacatacaccggagtgacccagcacaatcatgcgagctttgtgaaccttctgaacatcgagacagactataccaaaaatttccactttcattctaagcgggtcacagctcacggcgatacgccccagctcgacctgaaagccagaccgacctacggggccggagaaattacagttctggtggaggtggctgatatggaacttcataccaagaaaatcgagatttccggcctgaagttcgccagcctcgcttgcacagggtgttacgcctgttcttccagcatctcctgcaaggtccgcattcacgtggacgagcctgatgaactgaccgttcacgtgaaaagcgacgatcccgacgtcgtggcggcctctagctccctcatggctcggaagctggagttcggaacggactctacctttaaagccttcagcgctatgcccaagacatccctttgcttttatatcgttgaaagagagcattgtaaatcttgcagcgaagaggataccaagaagtgcgtgaacacaaaactggagcagcctcaatccattctcatcgaacacaagggcaccatcattgggaaacaaaattctacatgtaccgccaaggcgagctgctggctggagtccgtcaagagcttcttttacggcctgaagaacatgctttctggaatcttcggcaatgtgtttatggggattttcctgtttctcgccccgttcatcctgctcattctgtttttcatgtttggatggcgcatccttttctgtttcaagtgctgtagacggacgcgcggcctgtttaaatatagacatctcaaggacgatgaagagacagggtaccggcgcatcattgaaaaactgaacaataagaaaggaaagaacaagctgcttgacggcgagagactggctgatggccggatcgccgagcttttctccaccaaaacccacattgggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16996 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (opt5)
  source 1..3769: mol_type = other RNA
gggagaaagcttaccatggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaagctgctgcaagtgtctgagtccacaggagtggctctcaaacggagctcctggctgatcgtcctgctcgtgctgttcacggtttctcttagccccgtgcagtccgcccctattggccaggggaagaccatcgaggcttatagagcccgcgaaggatacacaagcatttgtctgtttgtcctcggctctatcctgttcatcgtgtcctgccttatgaaagggctggttgatagcgtgggaaattctttctttcccggcctcagcatttgtaagacctgctccatctctagcattaacggctttgagatcgaatcccacaaatgttattgcagcctgttctgctgtccgtactgccggcattgttctacagacaaggagattcacaagctgcatctctccatctgcaaaaagagaaaaaccgggagcaatgtcatgctggcggtgtgtaaacttatgtgcttccgcgccacgatggaagtctctaaccgggctctgtttattagatccatcatcaatacaaccttcgtgctctgtattctgatcctggccgtttgcgtggtcagcacctccgctgtggagatggagaaccttcctgccggaacatgggaacgcgaggaagatctcaccaacttttgtcaccaggagtgccaagttacagaaacggagtgtctgtgcccctatgaggccctggtgctccggaagcctctgttccttgactctaccgctaagggcatgaagaatctgctcaacagcacatccctggaaacctctctgagcattgaggcgccctggggagccatcaatgtccagtccacatacaaacccaccgtgagcacggctaacattgccctttcttggtccagcgtggaacacagagggaataagatcctcgtttctggccgctccgagagcatcatgaaactggaggaacggaccgggatttcttgggatctgggcgtcgaggacgccagcgaatccaagctcctgacagtgagcgtgatggatctttctcagatgtattcccctgtctttgagtacctgagcggagacagacaagtggaagagtggccgaaagctacctgcacaggcgattgtcccgagcgctgcgggtgtacctcctctacgtgcctccataaggaatggcctcacagccggaactggagatgtaatcccacatggtgctggggagttggcaccgggtgtacatgctgtggactggacgtgaaggatctgttcaccgactacatgtttgtcaaatggaaggtggagtatatcaaaaccgaagccattgtttgcgtggagcttacatcccaggaacggcagtgttctctcatcgaggcgggcacgcgcttcaacctggggcctgtcaccattacactgagcgagcccagaaatatccagcaaaagctcccgcctgaaatcattaccctgcatccccggatcgaggaaggctttttcgaccttatgcacgtgcagaaagttctgtccgcttctacagtgtgcaagctccagagctgcacccatggagtccctggcgatcttcaggtgtaccacattgggaacctgcttaagggagacaaagtgaatggccacctcatccataagattgagccccactttaacacgtcctggatgagctgggatgggtgtgacctggattattactgcaatatgggagactggccttcttgtacatataccggcgtcacccaacataaccacgcctccttcgttaatctgctcaacatcgaaacagattacaccaaaaactttcacttccatagcaagagagtgacagcccacggggacacgccccagctggatcttaaagctcgcccgacctatggcgccggagagatcacagtgctggtcgaggtggctgacatggaactccataccaagaaaattgagatctctggcctgaagttcgcctccctggcgtgcacagggtgttacgcctgctctagctccattagctgtaaggttcggatccacgtggatgaacctgacgagcttaccgtccatgtgaaatccgatgaccccgacgttgtggctgccagctctagcctgatggctagaaagctcgagtttggaacggattccaccttcaaagccttttctgcgatgcccaagacaagcctgtgcttctacattgtcgaacgcgagcactgtaaatcctgctctgaagaggacaccaagaagtgtgtgaatacaaaactcgaacagcctcagagcatcctgattgagcacaagggcaccatcatcgggaaacaaaactccacatgcaccgccaaggcttcttgctggcttgagagcgttaaatcctttttctatggactgaagaatatgctcagcggcatttttgggaacgtgttcatgggcatctttctgttcctggccccgtttattcttctgatcctcttctttatgttcggatggcggattctgttctgttttaagtgctgtagacgcacgagaggcctcttcaaataccggcatctgaaggatgacgaagagacagggtatcgcagaatcatcgaaaaacttaataacaagaaaggaaagaataagctgctcgatggcgagcggctggctgacgggcgcattgccgaactgttttctaccaaaacccacatcggatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16997 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (opt5)
  source 1..3190: mol_type = other RNA
gggagaaagcttaccatggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaaacttctgcaagtgtctgagtccacaggagtggctctcaagcggagctcctggctgatcgtcctgctcgtgctgttcacggtttctcttagccccgtgcagtccgcccctattggcagaaagcccctgtttctcgatagcaccgctaaagggatgaagaatctgcttaactctacatccctggagaccagcctctctatcgaagccccgtggggagcgattaatgtccagagcacatataaacctaccgtgtccacggccaacatcgctctgtcttggagctccgttgagcaccgcggcaataagatcctggtgagcgggcggtctgaatccattatgaagctcgaggaaagaacaggaatcagctgggacctgggcgtcgaggatgcctctgagtccaaacttctgaccgtgagcgtcatggacctctcccagatgtactctcccgtgttcgaatatctgagcggcgatcgccaagttgaggaatggcctaaggctacctgtacaggggactgccccgagcggtgtggatgcacctcctctacatgtctgcataaagaatggccccacagcagaaactggcgctgcaaccctacgtggtgctggggcgtggggaccggatgtacatgctgtggccttgatgtcaaggacctctttaccgattacatgttcgtgaaatggaaggttgagtatattaagacagaggccatcgtgtgcgtcgaactgacctcccaggagcggcagtgtagcctgattgaagccgggacgagatttaatctcggcccggtgaccatcacactgtctgagccccgcaacattcaacagaaacttcctcccgagatcatcaccctgcatcctcggattgaagagggattcttcgacctcatgcacgtgcagaaggttctgtccgctagcacagtctgcaaactgcagtcttgtacccacggcgtgcccggggatcttcaagtgtaccatatcggaaatctcctgaagggcgacaaagtcaacgggcacctgattcataagatcgaaccgcactttaatacgtcctggatgagctgggacggatgcgatctcgactattactgtaacatgggcgattggccttcttgcacatacaccggggtgacacagcataatcacgcgagcttcgttaacctgcttaatattgagaccgactataccaagaactttcacttccattccaaaagagtgacagcccacggcgatacgccccagctggacctcaaggctcgccctacctacggagccggcgaaatcacagtcctggtggaggttgccgatatggagctgcataccaaaaagatcgaaattagcgggcttaaatttgcttctctcgcctgtacaggatgctatgcgtgctccagctccatctcttgtaaggtgcggattcacgtcgacgagcccgatgaactgaccgtgcacgttaagagcgacgatcctgacgtggtcgctgcctcctctagcctgatggccagaaaactcgagttcggcacggattccacatttaaggctttctctgccatgcccaaaaccagcctgtgcttttacatcgtggaacgggagcattgtaagtcctgcagcgaggaagacaccaaaaagtgtgtgaatacaaaacttgagcagccgcaatctattctgatcgaacacaaggggaccatcattggaaagcagaactccacatgcacggctaaagccagctgttggctcgagtctgtcaagtccttcttttatggcctgaaaaatatgctgagcgggatcttcggcaacgtttttatgggaattttccttttcctcgcgccttttatcctgctgattctcttctttatgttcggctggcgcatcctgttttgcttcaagtgttgcagacggaccagagggctttttaaataccgccatctgaaggacgatgaagagacaggatatcggagaatcattgagaagctcaataacaaaaagggcaaaaacaagctgctggacggggaacgccttgccgatggaagaatcgctgagctgttctctaccaaaacacacattggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16998 - RNA, 1246 nt, synthetic construct
  misc_feature 1..1246: note = mRNA product Design1 comprising derived and/or modified sequence from CCHVF(10200)__U39455.2__IgE-leader_Gn (opt5)
  source 1..1246: mol_type = other RNA
gggagaaagcttaccatggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaaacttctgcaagtgtctgagtccacaggagtggctctcaagcggagctcctggctgatcgtcctgctcgtgctgttcacggtttctcttagccccgtgcagtccgcccctattggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 16999 - RNA, 2206 nt, synthetic construct
  misc_feature 1..2206: note = mRNA product Design1 comprising derived and/or modified sequence from CCHVF(10200)__U39455.2__IgE-leader_Gc (opt5)
  source 1..2206: mol_type = other RNA
gggagaaagcttaccatggactggacctggatcctgttcctcgtggccgctgccacaagagtccacagctttctggattccacggcgaagggcatgaaaaaccttctcaattctaccagcctggagacatccctgtctattgaagctccctggggagccatcaacgttcagagcacctacaagcctacagtgtccaccgccaatattgctctttcttggagctccgtggagcatcgggggaacaaaatcctggtcagcggccgctctgaatccattatgaagctcgaggaaagaacagggatcagctgggacctgggagtggaggatgcctctgagtccaaactgctcaccgttagcgtgatggacctgtctcaaatgtattccccggtcttcgaataccttagcggcgatcgccaggtggaggaatggcccaaggctacgtgcaccggggactgtcctgagcggtgcggatgtacatcctctacctgcctgcacaaggagtggccccatagcagaaattggcggtgtaaccctacatggtgctggggcgttggcaccgggtgtacgtgctgtggactcgatgtgaaagacctgtttacagattatatgttcgtcaagtggaaagtggaatacatcaagaccgaggccattgtgtgcgtcgaacttacatcccaggagcgccagtgtagcctgatcgaagcgggcaccagatttaatctcgggcccgttaccattacactgtctgagcctcggaacatccaacagaaactgccgcccgagattatcacgctccaccctcgcattgaagagggattctttgacctgatgcatgtgcagaaggtgctttccgccagcaccgtctgcaagctgcagtcttgcacacacggcgtgcccggggatctccaagtttatcacatcggaaatctgcttaaaggcgacaaggtgaacggccatctgatccacaaaattgaacctcatttcaataccagctggatgtcctgggatgggtgtgacctcgactactattgcaacatgggagattggccctcttgtacatacaccggcgtcacgcagcacaatcacgctagctttgtgaacctgctgaatatcgagacagactacaccaagaacttccattttcactccaaaagagttaccgcccatggggatacaccgcagctcgacctgaaggctcggcctacctatggagccggcgaaattacagtgcttgtcgaggtggcggatatggagctgcacacgaaaaagatcgaaattagcgggctcaagttcgcctctctggcttgcaccggatgttacgcctgctccagctctatctcctgtaaagtccgcatccatgtggacgagcccgatgaacttacagttcacgtgaagtccgacgatcctgacgtcgtggctgcctcctctagcctgatggccagaaaactcgagtttggcaccgattccacattcaaggctttctctgcgatgcccaaaaccagcctgtgcttttatattgttgaacgggagcactgtaagtcctgcagcgaggaagacacgaagaaatgtgtgaacaccaagctggagcagccccaatctatcctcattgaacataaaggcacaatcattgggaagcagaatagcacatgcaccgccaaagctagctgctggctggagtctgtcaagtccttcttttacggacttaagaacatgctgagcggcatcttcgggaatgtgtttatgggaatcttcctctttctggcccctttcattctgcttatcctctttttcatgtttggctggcgcattctgttctgttttaaatgctgtagacggaccagagggctgttcaagtatcgccacctcaaagacgatgaggaaacgggctaccggagaatcattgagaagctgaacaataaaaagggaaagaacaaacttctggacggcgaacgcctcgccgatgggcggatcgctgagctgttctctacaaagacccatattggatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17000 - RNA, 1666 nt, synthetic construct
  misc_feature 1..1666: note = mRNA product Design1 comprising derived and/or modified sequence from CCHFV(10200)__NC_005302.1/U88410.1__N (opt11)
  source 1..1666: mol_type = other RNA
gggagaaagcttaccatggaaaacaaaatcgaggtgaacaacaaagacgaaatgaaccgatggttcgaagagttcaagaaaggcaacggacttgtagacacgttcaccaactcctactccttctgcgaatcagtccccaacctagaccgattcgtcttccaaatggccagcgcaacagacgacgcacaaaaagactcgatatacgcatccgccctagtagaagcaaccaaattctgcgcccccatctacgaatgcgcttgggtatctagcacaggaatcgtcaagaaaggactcgaatggttcgagaaaaacgccggcacaatcaaatcctgggacgaatcatacaccgaactaaaagtagacgtacccaaaatagaacaactcaccggctaccaacaagccgcactaaaatggcggaaagacatcggcttccgcgtcaacgccaacaccgccgccctctccaacaaagtcctagccgaatacaaagtccccggcgaaatcgtcatgtccgtcaaagaaatgctctccgacatgatcagacggcgcaacctcatccttaaccgcgggggagacgaaaatccccgcggacccgtctctcacgaacacgtcgactggtgccgcgagttcgtcaaaggcaaatacataatggcgttcaacccaccctggggagacataaacaaatcaggccggtcaggcatcgccctcgtcgccaccggactagccaaactcgcagaaacggaaggcaagggcatattcgacgaagctaagaaaaccgtcgaggcacttaacggatacctagacaaacacaaagacgaggtcgaccgagccagcgcagacagcatgataaccaacctactgaaacacatcgcaaaagcgcaagaactatacaaaaactcctcagccctccgagcccaaagcgcacaaatcgacacagcattctccagttactactggctctacaaagcaggagtcacccccgaaacattccccacagtcagccaattcctcttcgaactaggaaaacaaccccgaggcacaaagaaaatgaagaaagcgttactcagcacccccatgaaatggggcaagaaactatacgaactcttcgccgacgactccttccaacaaaaccgcatatacatgcacccggccgtacttaccgcaggacgcatatcagagatgggcgtctgcttcggtaccatccccgtggccaacccagacgacgcagcacaaggatctggccacaccaaaagcatcctcaacctccgcacaaacaccgaaaccaacaacccatgcgcaaaaacaatagtcaaactattcgaagtccaaaagaccggcttcaacatccaagacatggacatcgtcgcatctgaacacctactccaccaaagcctggtcggaaaacaatcccccttccaaaacgcctacaatgtcaaaggcaacgcaacctccgccaacatcatctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17001 - RNA, 1666 nt, synthetic construct
  misc_feature 1..1666: note = mRNA product Design1 comprising derived and/or modified sequence from CCHFV(Turkey-Kelkit06)__GQ337053.1__N (opt11)
  source 1..1666: mol_type = other RNA
gggagaaagcttaccatggaaaacaaaatagaagtcaactccaaagacgaaatgaacaaatggttcgaagaatttaaaaaaggcaacggcctaatggacacattcaccaactcttactccttctgcgaaaacgtccccaacctcgacaaattcgtcttccaaatggcctccgccaccgacgacgcccaaaaagactcaatctacgcctccgccctagtcgaagccacgaaattctgcgccccaatctacgaatgcgcctgggtaagctccaccggcatagtgaaaaagggcttagaatggttcgagaaagactccggaaccataaaatcatgggacgaaaactacgcagaactcaaagtagacgtacccaaaatcgagcaactcgccaactatcagcaagcagccctaaaatggcgcaaagacataggtttccgcgtaaacgccaacaccgccgccctctcaaacaaagtcctcgccgaatacaaagtcccgggagaaatcgtgatgtcagtcaaagaaatgctaagcgacatgatccgccgccgcaatctaatcctcaaccgcggtggagacgaaaacccccgagggcccgtcagccgagaacacgtcgaatggtgcagagaatttgtaaaaggcaaatacattatggcatttaacccaccatggggcgacatcaacaagtcaggacgaagtggaatcgcactcgtcgccacaggcctcgccaaactcgcagaaaccgaaggaaaaggcgtcttcgacgaagcaaaaaaaaccgtcgaggcccttaacggatacctcgacaaacaccgcgacgaagtcgacaaagcctccgcggactccatgataacaaacctcccaaaacacatcgcgaaagcccaagaactctacaaaaactcctcagcactcagagcccaaggagcccaaattgacaccccgttctccagcttctactggctttacaaagcaggcgtcacccccgaaacattccccaccatcagccagttcctattcgaactcggagaacaaccaagaggaacaaaaaaaatgaaaaaggccctcctctccacacccatgaaatggggaaaaaaactgtacgaactcttcgccgatgactcattccaacaaaaccgcatctacatgcaccctgccgtcctcaccgccggccgcataagcgaaatgggggtctgcttcggcaccatacccgtcgccaatccagacgatgcagcccaaggctccggacataccaaaagcatcctgaacctccgaaccagcacagaaaccaacaacccctgcgccaagacaatcgtcaagctatttgaaatccaagaaaccggcttcaacatacaggacatggacatcgtcgcctcggaacacctcctccaccaatccatcgtcggaaaacaaagtcccttccagaacgcatacaacgtcaaaggcaacgccacatccgccaacatcatctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17002 - RNA, 5272 nt, synthetic construct
  misc_feature 1..5272: note = mRNA product Design1 comprising derived and/or modified sequence from CCHFV(10200)__U39455.2__GP (opt11)
  source 1..5272: mol_type = other RNA
gggagaaagcttaccatgcacatcagcctgatgtacgccatcttatgcctacagctgtgcggcctcggggaaacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgatgtcgacccctccacccagacggccgggggcaccagcgcccccaccgtgcggacgtccctgccgaacagcccctcgacgcccagcacgccccaggacacccaccacccggtgcgcaacctcctgtccgtcaccagccccgggcccgacgagaccagcaccccgtccggcaccggcaaggagagctccgccaccagctccccgcacccagtgagcaaccggcctcccacgccacccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctaacgctcgaggaggacacggagggcctgctcgaatggtgcaagcggaacctcgggctggactgcgacgacaccttcttccagaagcggatcgaggagttcttcatcaccggcgaggggcacttcaacgaggtgctgcagttccggacgcccggcaccctctccactaccgagagcacgccggccgggctgcccaccgccgagcccttcaaatcctacttcgccaagggtttcctgagcatcgactccggctactacagcgccaagtgctacagcgggacctccaacagcggcctccagctgatcaacatcacccgccactccactcggatcgtagacacccccgggccgaagatcacgaacctgaagaccatcaactgcatcaacctcaaggcgagcatcttcaaggagcaccgagaggtggagatcaacgtgctgctgccccaggtggccgtcaacctctccaactgccacgtggtgatcaagagccacgtgtgcgactactccctggacatcgacggcgccgtgcggctgccccacatctaccacgagggggtgttcatccccggcacgtacaagatcgtcatcgacaagaagaacaagctcaacgaccgctgtacccttttcaccgactgcgtgatcaagggacgggaggtgcgcaagggccagagcgtcctgcggcagtacaagactgagatccgcatcggcaaggcctccaccgggttccggcgcctcctgagcgaggaaccgtccgacgactgcgtgagccggacccagctgttacgcacagagaccgccgagatccacggcgacaactacgggggccccggcgacaagatcacgatctgcaacgggtccaccatcgtcgaccagcgcctgggcagtgaactggggtgctacaccatcaaccgggtgcgctccttcaaactgtgcgagaacagcgcgaccggcaagaactgcgagatcgactccgtgcccgtcaagtgccggcagggctactgcctccgcatcacgcaggaggggcgtggccacgtgaagctgagccgcgggagcgaggtggtcctggacgcctgcgacacctcctgcgagataatgatccccaagggcaccggggacatcctagtggactgcagcgggggccagcagcacttcctgaaggacaacctgatcgacctcgggtgcccgaagatccccctgctgggcaagatggccatctacatttgccggatgtccaaccaccccaagaccacgatggccttcctcttctggttcagcttcgggtacgtgatcacgtgcatcctgtgcaaggctatcttctacctgctcatcatcgtcggcaccctggggcgccggctgaagcagtaccgtgagctcaagccccaaacctgcaccatctgcgagaccaccccggtaaacgcgatcgacgccgagatgcacgacctgaattgctcctacaacatctgcccctactgcgcctcccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgtttaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaagggtctggtggacagcgtcggtaactccttcttccccggcctgagcatctgcaagacgtgcagcatctccagcatcaacgggttcgagatcgagtcccacaagtgctactgcagcctcttctgctgcccgtactgtcggcactgctccaccgacaaggagatccacaaactgcacctgagcatctgcaagaagcgcaagaccggctccaacgtgatgctcgctgtgtgcaaactgatgtgcttccgcgcgaccatggaggtaagcaaccgggccctgttcatccgctccatcatcaacacgaccttcgtgctctgcatccttatcctggccgtgtgcgtcgtgagcacctccgccgttgagatggagaacctccccgccgggacctgggagcgggaggaggacctgacgaacttctgccaccaggagtgccaagtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcatggagcagcgtggagcaccggggaaacaaaatcctcgtgtccggccgcagcgagtccatcatgaagctggaggagcggaccggtatcagctgggaccttggagtcgaggacgcctccgagagcaagctcctgaccgtgtccgtgatggacctaagccaaatgtactcccccgtcttcgagtacctcagcggggaccgccaggtggaagaatggcccaaggcgacctgcacgggcgactgcccggagcggtgcggctgcacctccagcacgtgcctgcacaaggagtggccccactcccgcaactggaggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccaatgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtgtgcaagctccagtcctgcacccacggggtgcccggcgacctccaggtgtaccacatcgggaacctgctgaagggcgacaaggtcaacgggcacctgatccacaagattgagccccacttcaacactagctggatgagctgggacggctgcgatctggactactattgcaacatgggcgactggccctcctgcacctacacaggggtgacccagcacaaccacgccagcttcgtgaacctcctgaacatcgagaccgactacaccaagaacttccacttccactccaagcgcgtcacggcccacggcgacacgccccagcttgacctcaaggcccggccgacctacggggcgggcgagatcaccgtgctggtggaggtagccgacatggagctgcacaccaagaagatcgagatcagcgggctcaagttcgcctccctggcctgtaccggctgctacgcctgcagctccagcatctcctgcaaagtgcgcatccacgtggacgagcccgacgagctaaccgtccacgtcaagagcgacgaccccgatgtggtggcggcctcgtcttccttaatggcccggaagctggagttcggcaccgactcgacgttcaaggccttctccgccatgcccaagaccagcctgtgcttctacatcgtggagcgcgagcactgcaagtcctgcagcgaggaagacaccaagaaatgcgtgaacaccaagctcgagcagccgcaatccatcctgatcgagcacaaggggacgatcatcggcaagcagaactccacgtgcaccgcgaaagccagctgctggctggaaagcgtcaagagcttcttctacgggctgaagaacatgctctccggcattttcggcaacgtgttcatggggatctttctgttcctggcccccttcatcctcctgatcctgttcttcatgttcggctggcggatcctcttctgcttcaagtgctgccgccgcacccgggggctgttcaagtaccgccacctgaaagacgacgaggagaccggctaccggcgcattatcgaaaagctcaacaacaagaaggggaagaacaagctgctggacggtgagcggctcgccgacggccgcattgccgagctgttcagcaccaagacccacatcgggtaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17003 - RNA, 5272 nt, synthetic construct
  misc_feature 1..5272: note = mRNA product Design1 comprising derived and/or modified sequence from CCHFV(IbAr10200)__AF467768.2__GP (opt11)
  source 1..5272: mol_type = other RNA
gggagaaagcttaccatgcacatcagcctgatgtacgccatcctctgcctgcagctgtgcggcctcggggagacccacggctcccacaacgagacccgccataacaaaaccgacaccatgacgacgcccggggacaacccgagctccgagccgcccgtcagcaccgccctgtcgatcaccctggaccccagcactgtcacgccgacgacccccgcgtccggcctcgaggggagcggagaggtatacacctcaccgcccataaccacgggcagcctgcccctgtccgagaccacccccgagctccccgtgaccacgggaaccgacaccctcagcgccggcgacgtcgacccctccacccagacggccgggggcaccagcgccccgaccgtgcggaccagcctgcctaactctccctccacgcccagcacgccgcaggacacccaccaccccgtgcgcaacctcctgtccgtcaccagccccgggcccgacgagacgagcaccccgtccggcaccgggaaggaaagctccgccacaagcagcccccaccccgtgagcaaccggcccccgaccccgcccgcgaccgcccagggtcccacagagaacgactcccacaacgccaccgagcacccggagagcctgactcagtccgccacccccggcctcatgaccagccccacccagatcgtgcacccgcagtccgcgacccccatcacggtccaggatactcaccccagtcccacgaaccgctccaagcgaaacctgaagatggagatcatcctgaccctcagccaggggctgaagaagtactacggcaagatcctgcgcctcctgcagctgacgctagaggaggacaccgagggtctgctggagtggtgcaagcggaacctcgggctggactgcgatgacaccttcttccagaagcgcatcgaggagttcttcatcaccggcgaggggcacttcaacgaggtgctgcagttccgaacgccgggaaccctctccaccacagagagcacgcccgccgggctgcccacggccgagcccttcaagtcctacttcgccaagggcttcctgagcatcgactccggttactacagcgccaagtgctacagcgggacgtccaacagcggcctccagcttatcaacatcacccgccactccacgcggatcgtcgacaccccggggcccaagatcaccaacctgaagaccatcaactgcataaacctcaaggcgagcatcttcaaggagcaccgcgaggtcgagatcaacgtgctgctgccccaggtggccgtaaacctctccaactgccacgtagtgataaagtcacacgtctgtgactacagtctggacatcgacggcgccgtgcggctgccccacatctaccacgagggggtgttcatccctggcacgtacaagatcgtcatcgacaagaagaacaaactcaacgaccgctgcaccttattcacagactgcgtgataaagggccgggaggttcgcaaggggcaaagcgtcctgcggcagtacaagaccgagatccgcatcgggaaggcctccacggggagccggcggctcctgtccgaggagcccagcgacgactgcatttcccggacccagctgctccgcaccgaaaccgccgagatccacggcgacaactacgggggccccggcgacaagatcacgatttgcaacggcagcaccatcgtggaccagcgcctgggctccgagctagggtgctacacgatcaaccgtgtccgcagcttcaagctgtgcgagaactcggctaccggcaagaactgcgagattgactcagtgcccgtgaagtgccggcagggctactgcctccgtatcactcaggaggggcggggccacgtgaagctgagccgcgggtccgaggtggtgctcgacgcctgcgacaccagctgcgagatcatgatccctaagggcaccggggacatcctcgtcgactgctccggcggccagcagcacttcctcaaggacaacctgatcgatctcgggtgtcctaagatccccctgctgggcaagatggccatctacatctgccggatgagcaaccaccccaagaccacgatggcattcctcttctggttctccttcgggtatgtgatcacctgtatcctctgcaaggctatcttctacctccttatcatcgttggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgtctgaccagcgacgggctcgcccggcacgtgattcagtgccccaagcgcaaagaaaaggtggaggagaccgagctgtacttaaacctcgaacggatcccgtgggtcgtgcgcaagctgctgcaggtatccgagagcacgggcgtcgccctcaagcggtccagctggctgatcgtactgctcgtgctgttcaccgtctccctgagccccgtacagtccgcgcccatcgggcagggcaagaccatagaagcgtaccgcgcccgggaggggtacacttctatttgcctcttcgtgctgggctccatcctgttcatcgtcagttgtctcatgaaggggctcgtggactcagtgggcaacagcttcttcccgggcctgagcatctgcaagacgtgctcgatcagctccatcaatgggttcgagatcgagagccacaagtgctactgctccctcttctgctgcccctactgccgccactgcagcaccgacaaggagatccacaagctgcacctgtctatatgcaagaagcggaagaagggcagcaacgtcatgttagccgtttgcaagctgatgtgcttccgcgcgaccatggaggtgtccaaccgcgccctgttcatccggagcatcatcaacactacgttcgtcctctgcatactgatactggccgtgtgtgtggtctccaccagcgccgtggagatggagaacctccccgccgggacctgggagcgcgaggaagacctgaccaacttttgccaccaagagtgccaagtgacggagaccgagtgcctgtgcccctacgaggcgctcgtcctgcggaagccgctgttcctcgactccaccgccaagggcatgaagaacctgctgaacagcacatccctcgagacaagcctgtccatcgaggccccctggggcgccatcaacgttcagagcacatacaagccgaccgtgtccaccgctaacattgcactgagctggagctccgtcgagcaccgcgggaacaagatcctcgtgagcggccgatccgagagcatcatgaagctggaggagcgcacggggatctcctgggacctgggcgtggaggacgccagcgagtccaagctcctgaccgtcagcgtcatggacctgtctcagatgtacagcccggtgttcgagtacctcagtggggaccggcaggtcggagagtggccgaaggcaacctgcaccggcgactgccccgagcgctgcgggtgcacgagctcgacttgcctgcacaaggagtggccccatagccggaactggcgctgcaaccccacctggtgctggggcgtggggaccggctgcacgtgctgcgggctggacgtcaaagacctctttaccgactacatgttcgtaaagtggaaggtggagtatatcaagaccgaggccatcgtgtgcgtcgagctgaccagtcaggaacggcagtgtagcctgatcgaggccggcacgcgattcaacctcggcccggtgaccataaccctgtccgagccccggaacatccagcagaagctgcccccggagatcatcaccctccacccgcgcatcgaagaagggttcttcgacctgatgcacgtccagaaggtactgagcgccagtacagtgtgcaagctccagtcctgcacgcatggcgtcccaggggacctccaggtgtaccacatcggcaatctgctgaaaggggataaggtgaacggccacctgatccacaaaatagagccccacttcaacaccagctggatgtcctgggacggctgtgacctggactactactgcaacatgggggactggcccagctgcacctacaccggcgtcacgcagcacaaccacgcctccttcgtcaacctcctgaacatcgagaccgactacaccaagaacttccacttccacagcaagcgtgtgaccgcccacggggacacgccgcagttagacctcaaagcccgccccacgtacggcgcgggggagatcaccgtactggttgaggtggccgatatggagctgcacactaagaagattgaaatctccggcctcaagttcgcctcgctggcctgcacgggctgctacgcctgctcctcagggatctcctgcaaggtccggatccacgtagacgagcccgacgagctgacagtgcacgtcaagagcgacgaccccgacgtggtggcggcctccagctccctcatggcccgcaagctggagttcggcaccgacagcacctttaaggccttctccgccatgccgaagacgagcctgtgcttctacatcgtcgagcgggagcactgcaaatcctgcagcgaggaggacaccaagaagtgcgtgaacaccaaactcgagcagccccagtccatcctgatcgagcacaaggggaccatcataggcaaacagaacagcacgtgcaccgcgaaggccagctgctggctggagtccgtgaagtccttcttctacggcctgaagaacatgttatccgggatcttcggcaacgtcttcatggggatcttcttgttcctggcacccttcattctccttatcctgttcttcatgttcggctggcgcatcctcttctgcttcaagtgctgccgccgcacccgcgggctgttcaagtaccggcacctgaaggacgacgaggagaccggatatcgccggatcatcgagaagctcaacaacaagaagggcaagaacaagctgctggatggcgagcgcctcgccgaccggcgcatcgccgaactgttcagcacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17004 - RNA, 5284 nt, synthetic construct
  misc_feature 1..5284: note = mRNA product Design1 comprising derived and/or modified sequence from CCHFV(Turkey-Kelkit06)__GQ337054.1__GP (opt11)
  source 1..5284: mol_type = other RNA
gggagaaagcttaccatgcccaccaacattatgcacaccccgctggtgtgcttcatcctctacctgcagctgttatgcctgggcggggcccacggccaactgaacgccacggagcacaacgggaccaacaacacaacggcgcccggcgccagccagtcccccaaacccccgatgagcactacaccaccccacgcccccgagtccagcaccatcaagccgaccacgccaatttccgaggccgaggggagcggagagaccacctccccgcccaataccacgcagggcctcagttcccccgagaccaccagcgagcgccctgccaccacgtccatcagcacttccagcaccgactccaccaaccccacgacgcagatgaccgacaacacccccactccgaccgtctcgacctcccccagctccagccccagcaccccctccactccgcaggggatccaccacccagcgcggagcctgctgtccgtttcttcccccaagaccgtgaccacccccacgccgaccagccccggtgagatgtccagcgagacctccagccagcacagcgccatgagccgcatccccactccccacaccgcgacccgggtatccaccgagatcaccaaccaccgcaccccgcggcagagcgagtcaagcgcccagcagacgacgccttcccccatgaccagcccggcgcagtccatcctcctgatgagcgccgcacccaccgccgtgcaggacatccaccccagcccaacgaaccgctccaagcggaacctggaaaccgagatcatcctcaccctcagccaggggctgaagaagtactatggcaagattctcaagctcctgcacctcaccctggagcaagacacggaggggctgctcgaatggtgcaagggcaacctgggctccaactgcgacgacgacttcttccagaagaggatcgaggagttcttcatgaccggggagtgctacttcaacgaggtgctgcagttcaagaccctcagcaccctgtccccgaccgagcccagccatgcccggctgcccaccgcggagcccttcaagtcctacttcgccaaggggttcctgagcatcgactccgggtatttcagcgccaaatgctacccgcgctccagcgcctcaggcctgcagctgatcaacgtcacccagcaccccgcccggatcgctgagacccccggccccaaaacgactagcctcaagaccatcaactgcatcaatctgcgcgcctccgtgttcaaggagcacagagaggtggaaatcaacgtgctgctcccgcagatagccgtgaacctgagcaactgccacgtggtcatcaactcccacgtgtgcgactacagcctggacaccgacgggcccgtgcgtctcccccgcatctaccacgagggcacgttcatccccgggacatacaagatcgtcatcgacaagaagaacaagctgaacgaccgctgcacgctggtgacgaactgcgtgatcaagggccgggaggtccgcaaagggcagagcgtgttgcgtcagtacaagaccgagatcaagatcggcaaggcctccaccgggttccgcaagctgctgagcgaggaaccgggggacgactgcatctcccggacccaactcttgcgcaccgagacggctgagatccacgacgacaactacggcgggcccggcgacaaaatcaccatctgcaacggctcaactattgtggaccagagactgggctccgagttaggctgctacaccatcaaccgggtcaagagctttaagctgtgcaagaactccgcgacggggaagacctgcgaggtcgacagcacccccgtgaagtgccgtcagggcttctgtctcaagattacccaggaggggcggggccacgtgaagctgtcccgcgggtcagaggtggtactggacgcctgcgactccagctgcgaggtgatgatccccaagggcacgggcgacattctagtggactgcagtgggggtcaacaacactttctaaaagacaacctcatcgacctggggtgcccgcacatccccctgctcggccggatggccatctatatctgccgcatgagcaaccacccccggaccactatggccttcttgttttggttctcctttggctacgtgattacctgcatcttctgcaaggccctgttctattcgctcatcatcatcggaaccctgggtaagaagatcaagcagtaccgcgagctgaagccccagacgtgcaccatctgcgagaccgcgccggtgaacgccatcgacgccgagatgcacgacctcaactgctcctacaacatctgcccctactgcgcgagcaggctgacctccgacggactggcgcgccacgtgacgcaatgccccaagcggaaggagaaggtcgaggagaccgagctctacctgaacctggagcgcatcccgtggatcgtgcggaagctcttacaggtgagcgagagcaccggcgtcgccctgaagcgctccagctggctgatcgtgctgctggtactcctgaccgtctccctgagccccgtgcagtccgcccccgtcgggcacggcaagacgatcgagatctaccagacccgggagggcttcgctagcatctgcctcttcatgctggggtccatcctattcatcgtcagctgcctcgtgaagggcctggtggactccgttagcgagtccttcttccccgggctgtcggtgtgcaagacatgctccatcggcagcgtgaacgggttcgagatcgagtcccacaagtgctactgcagcctcttctgttgcccgtactgccgtcactgcagtgccgaccgggagatccaccagcttcatctgagcatctgcaagaagcgcaagaccggctccaacgtcatgctcgctgtgtgcaagcggatgtgcttccgcgccacgatcgaggcaagccgtcgggctctgctgatacgcagcataatcaacaccaccttcgtgatctgcatcctcaccctgacgatctgcgtcgtgtccaccagcgccgtggagatggagaacctgcccgccggcacctgggagcgggaagaggacctcaccaacttctgccaccaggagtgccaggtcacggagaccgagtgcctgtgcccctatgaagccctggtgctccgcaagcccctgtttctggactccatcgtgaaggggatgaaaaacctcctgaacagcacctccctggagaccagcctgtccatcgaggccccgtggggcgccatcaacgtgcagagcacattcaagcccaccgtgtccactgccaacatcgcgctgagctggtctagcgtggtccaccgggggaacaagatcctggttaccggccgctccgagagcatcatgaagctcgaggagcggacgggggtatcctgggacctgggcgtagaggacgccagcgagtcgaagctgctcaccgtgagcatcatggacctgtcccagatgtacagccccgtgttcgagtatctgagcggcgaccgccaggtagaggagtggcccaaggctacctgcaccggtgactgcccggagcggtgcggctgcacgtcgagcacctgtctccacaaggaatggtcccacagccgcaactggcggtgcaaccccacctggtgctggggcgtggggaccggatgcacgtgctgcggcgtggacgtcaaggacctatttaccgaccacatgttcgtgaagtggaaggtggaatacatcaaaaccgaagccatcgtttgcgtggcgctgacctcccaggagcgccagtgcagcctcatcgaggccggaacccggtttaacctagggccggtgacgattaccctctccgagccccgcaacatccagcagaaactcccgcccgagattatcaccctgcaccccaaaatcgaggagggctttttcgatctgatgcacgtccagaaggtgctcagcgcctccaccgtgtgcaagctgcagagctgcacgcacgggatccccggcgacctgcaggtctaccatatcggcaacctcctgaagggggaccgcgtgaacggccacctgatccacaagatcgagtcccacttcaacaccagctggatgtcctgggacgggtgtgacctcgactactactgcaacatgggcgactggccgagctgcacctacaccggggtcactcagcacaaccacgccgccttcgtgaacctgctgaacatcgagaccgactacaccaagaccttccactttcactccaagcgcgtaacggcgcatggcgacacccctcagctcgacctgaaggcccggcccacctacggcgccgggggcatcaccgtcctggtcgaggtggctgacatggagctccacactaagaaggtcgaaatcagcggactgaagttcgcctccctcgcgtgcaccggctgctacgcctgcagcagtgggatcagctgcaaggtacgcatccacgtggacgagccggacgagctcactgtccacgtaaagagcagcgacccggacgtggttgccgcgtcgacctcactgatggcccggaaactggagttcggcacggactcaacgtttaaggcgttctccgccatgcccaagaccagcctctgcttctacatcgtggagcgcgagtactgcaagtcctgcagcgaggacgacacccagaagtgtgtggacacgcggctggagcaaccccagtccatactgatcgagcacaaaggcacaatcatcgggaagcagaacgatacctgcaccgccaaggccagctgctggctcgagtccgtcaagagtttcttctacggcctgaagaacatgctggggtccgtgttcggcaacctattcatcgggatcctcctgttcctcgcgcccttcgtgttactcgtcctgtttttcatgttcggctggaagatcctcttctgcttcaagtgttgccgccgcacgcggggcctgttcaagtaccgccacctgaaggacgacgaggagaccgggtaccggagaatcatcgagcgactcaatagcaagaagggcaagaaccgcctgctggacggggaccgactcgccgaccgcaagatagccgagctattctccaccaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17005 - RNA, 3796 nt, synthetic construct
  misc_feature 1..3796: note = mRNA product Design1 comprising derived and/or modified sequence from CCHVF(10200)__U39455.2__SP-GP_Gn-NSm-Gc (opt11)
  source 1..3796: mol_type = other RNA
gggagaaagcttaccatgcacatcagcctgatgtacgccatcctctgcctgcagctgtgcggcctcggggagacccacggctcccacaacgagaccagcgaggagccctccgacgactgcgtgagccgcacgcagctgctgcggaccgagaccgccgagatccacggggacaactacggcgggccgggcgacaagatcaccatctgcaacggctccacgatcgtcgaccagcgcctcgggagcgagctgggctgctacaccatcaaccgggtgcgctccttcaagctgtgcgagaacagcgcgaccgggaagaactgcgagatcgactccgtgcccgtcaagtgccggcagggctactgcctccgcatcacccaggaggggcggggccacgtgaagctgagccgcggctccgaggtggtcctggacgcctgcgacacgagctgcgagatcatgatccccaaggggaccggcgacatcctcgtggactgctccgggggccagcagcacttcctgaaggacaacctgatcgacctcggctgccccaagatcccgctgctggggaagatggccatctacatctgccggatgagcaaccaccccaagaccaccatggccttcctcttctggttctccttcggctacgtgatcacgtgcatcctgtgcaaggccatcttctacctgctcatcatcgtcgggaccctgggccgccggctgaagcagtaccgcgagctcaagccccagacctgcaccatctgcgagacgacccccgtgaacgcgatcgacgccgagatgcacgacctgaactgcagctacaacatctgcccgtactgcgcctcccggctgaccagcgacgggctcgcccgccacgtgatccagtgccccaagcggaaggagaaggtcgaggagaccgagctgtacctgaacctcgagcgcatcccctgggtggtgcggaagctgctgcaggtctccgagagcacgggcgtggcgctcaagcgcagctcctggctgatcgtgctgctcgtcctgttcaccgtgagcctgtcccccgtgcagagcgccccgatcggccaggggaagaccatcgaggcctaccgggcccgcgagggctacacctccatctgcctcttcgtcctggggagcatcctgttcatcgtgtcctgcctcatgaagggcctggtggacagcgtcgggaactccttcttccccggcctgagcatctgcaagacgtgctccatcagctccatcaacggcttcgagatcgagagccacaagtgctactgctccctcttctgctgcccctactgccggcactgcagcaccgacaaggagatccacaagctgcacctgtccatctgcaagaagcgcaagaccgggagcaacgtgatgctcgccgtctgcaagctgatgtgcttccgcgcgaccatggaggtgtccaaccgggccctgttcatccgcagcatcatcaacacgaccttcgtgctgtgcatcctcatcctggccgtctgcgtggtgagcacctccgccgtcgagatggagaacctgcccgccggcacctgggagcgggaggaggacctcacgaacttctgccaccaggagtgccaggtgaccgagaccgagtgcctgtgcccgtacgaggcgctggtgctccgcaagcccctgttcctggacagcaccgccaaggggatgaagaacctcctgaactccacgagcctggagacctccctcagcatcgaggccccctggggcgccatcaacgtccagtccacctacaagcccaccgtgagcaccgccaacatcgcgctgtcctggagctccgtggagcaccgggggaacaagatcctggtcagcggccgctccgagagcatcatgaagctcgaggagcggacgggcatctcctgggacctgggggtggaggacgccagcgagtccaagctgctcaccgtgagcgtcatggacctgagccagatgtactccccggtgttcgagtacctgagcggcgaccgccaggtggaggagtggcccaaggccacctgtaccggggactgccccgagcggtgcggctgcacgtccagcacatgcctccacaaggagtggccccactcccgcaactggcggtgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacgcggttcaacctggggcccgtcaccatcaccctcagcgagccccgcaacatccagcagaagctgcccccggagatcatcaccctgcacccccggatcgaggagggcttcttcgacctcatgcacgtgcagaaggtgctgtccgcgagcacggtctgcaagctgcagtcctgcacccacggcgtgcccggggacctccaggtgtaccacatcggcaacctgctgaagggggacaaggtcaacggccacctcatccacaagatcgagccgcacttcaacaccagctggatgtcctgggacgggtgcgacctggactactactgcaacatgggcgactggcccagctgcacctacacgggcgtgacccagcacaaccacgcctccttcgtgaacctgctcaacatcgagaccgactacaccaagaacttccacttccacagcaagcgcgtcacggcccacggggacaccccccagctggacctgaaggcccggcccacctacggcgcgggggagatcaccgtgctcgtggaggtcgccgacatggagctgcacacgaagaagatcgagatctccggcctgaagttcgccagcctcgcctgcaccgggtgctacgcctgctccagcagcatctcctgcaaggtgcgcatccacgtggacgagccggacgagctgaccgtccacgtgaagagtgacgaccccgacgtggtcgcggcctccagctccctgatggcccggaagctcgagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctggagcagccccagtccatcctcatcgagcacaagggcacgatcatcgggaagcagaacagcacatgcaccgcgaaggcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcgcatcctcttctgcttcaagtgctgccggcgcacccggggcctgttcaagtaccgccacctgaaggacgacgaggagaccgggtaccggcgcatcatcgagaagctcaacaacaagaagggcaagaacaagctgctggacggggagcggctcgccgacggccgcatcgccgagctgttctccacgaagacccacatcggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17006 - RNA, 3769 nt, synthetic construct
  misc_feature 1..3769: note = mRNA product Design1 comprising derived and/or modified sequence from CCHVF(10200)__U39455.2__IgE-leader_Gn-NSm-Gc (opt11)
  source 1..3769: mol_type = other RNA
gggagaaagcttaccatggactggacctggatcctgttcctcgtggcagccgcgactcgcgtacactcatccgaggagcccagcgacgactgtgtgtccagaacgcagctgttgcgcacggagacggccgagatccacggcgacaactacgggggcccgggggacaagatcaccatatgcaacggcagcaccatcgtagaccagcggctcgggtccgagctaggctgttacaccatcaaccgtgtccggagcttcaagctgtgcgaaaattcagccaccggcaaaaactgcgagatcgacagcgttcccgtgaagtgtcgccaggggtactgcctccggatcacccaggagggcagagggcacgtcaagttatctcggggcagcgaggtagtgctggacgcgtgcgacacgtcctgcgagatcatgatacccaaggggaccggcgacatcctcgtcgactgcagcggcgggcaacagcacttcctgaaggacaacctgatcgatctcggctgccccaagatcccgctactggggaaaatggccatctacatctgccgaatgtccaaccacccaaagaccaccatggcgttcctcttctggttcagcttcgggtacgtgatcacatgcattctgtgcaaggccatcttctacctgctcatcatcgtgggcaccctggggcggcgcctgaaacagtacagagagctcaagccccagacctgcaccatctgcgagaccaccccggtcaacgcgattgatgccgagatgcacgacctaaactgttcctacaacatctgcccgtactgcgcgagccgcctgacgtccgacggcctcgcccggcacgtgatccagtgccccaagcgcaaggagaaggtggaggagaccgagttatacctcaacctagagcggatcccttgggtcgttcggaagttgctccaggtgagcgagtccacgggggttgccctcaagaggagcagctggctgatcgtgctgctcgtactgttcaccgtcagtctgagccccgtgcagtccgctccgatcgggcaggggaagaccatcgaggcgtatcgggccagggagggctacaccagcatctgcctcttcgtcctgggctccatcctgttcatcgtcagctgcctgatgaaggggctggtggacagtgtcggcaacagcttcttccccgggctaagcatctgcaagacgtgcagcatctcctccatcaacggcttcgagatcgaatcccacaagtgctactgctccctcttctgctgcccctactgccgccattgctccaccgacaaggagatccacaagctgcacctgtcaatctgcaagaagaggaaaaccgggtccaacgtgatgctagccgtgtgcaagctgatgtgtttccgggctaccatggaggtcagcaaccgcgccctgttcattaggtccattatcaataccactttcgtgctctgcatcctgatcctggcggtgtgcgtcgtgagcaccagcgcagtggaaatggagaacctacctgccggcacctgggagcgggaggaggatctcacgaacttctgccaccaggagtgtcaggtcacagagaccgagtgcctttgcccgtacgaggccctggtactcaggaagcccctgtttctggactccaccgccaagggcatgaaaaacctcctgaactccacatccctggagaccagcctctccatagaggccccctggggcgcgatcaacgtgcagtcaacctacaaacccaccgtctccaccgctaacattgccctgagctggtcctcggtggagcacagggggaacaagattctggtgtccgggcggtcagagagcatcatgaagctcgaggagcgcacgggcatcagctgggatctgggggtcgaagatgcctccgagagcaagttgctcacagtgagtgtaatggacctgagccagatgtacagcccggttttcgagtacctgtccggcgaccgccaggtggaagagtggcccaaggcaacttgcacaggcgactgccccgagcggtgcgggtgcacgagctcgacctgccttcataaagagtggccacacagccggaactggcgctgcaacccgacctggtgctggggcgtggggaccgggtgtacgtgctgcgggctggacgtcaaggacctgttcaccgactacatgttcgtgaagtggaaggtggagtacatcaagaccgaggcgatcgtctgcgtggagctcacctcgcaggagcgtcagtgcagcctgatcgaggccgggacgcgcttcaacctgggccccgtgaccatcaccctctccgaaccgcggaacatccaacaaaagctgccaccggagatcatcaccctgcacccccgcattgaggagggcttcttcgacctcatgcacgtccaaaaggtgctgagcgcatctactgtgtgcaaactgcagagctgtacccacggagtacccggggacctccaagtataccacatcggtaatctgctgaagggagacaaggtgaacgggcatctcatccacaagatcgagccgcacttcaatacctcctggatgagctgggacggctgcgacctggattactattgcaacatgggggactggccgtcctgcacttatacgggcgttactcagcacaatcacgccagcttcgtgaacctactcaacatagagaccgactacaccaaaaatttccactttcactccaagcgggtgacagcacacggggacactccccaactggacctgaaggcccgccccacctatggcgccggagagataacggtcctcgtggaggtggccgacatggagctgcacacgaagaagatcgagatcagcgggttgaagttcgcctccctcgcctgcaccggatgctatgcgtgcagctccagcatctcatgcaaggtccggatccacgtggacgagccggacgagctgaccgtgcacgtaaaaagcgacgaccccgatgtcgtggccgccagctccagcctgatggcgcgcaaactcgagttcgggaccgactccaccttcaaggcgttcagcgcaatgcccaagacgagcctgtgcttctacatcgtcgagagagagcactgcaagagctgctcagaggaggacaccaaaaagtgcgtgaacaccaagctggagcagccccagagcatcctaatcgaacataaggggacaatcatcgggaagcagaactccacttgcaccgcgaaagcctcttgctggctagagtctgtaaagagcttcttctacgggctaaagaacatgctctccggcatcttcgggaatgttttcatgggcatcttcttattcctcgcgcccttcatcctcctgatcctgttctttatgttcggatggcggattctgttctgtttcaagtgctgccgccggacccgcggccttttcaagtacagacatttgaaagacgacgaggagaccgggtacagaagaatcatcgagaagctcaacaacaagaaaggcaagaacaagctgctggacggcgaacggctcgctgacgggcggatcgccgaactcttcagcacgaagacccatattggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17007 - RNA, 3190 nt, synthetic construct
  misc_feature 1..3190: note = mRNA product Design1 comprising derived and/or modified sequence from CCHVF(10200)__U39455.2__IgE-leader_Gn-4aa-Gc (opt11)
  source 1..3190: mol_type = other RNA
gggagaaagcttaccatggactggacctggatcctctttctggttgccgcagccacccgcgttcactccagcgaagaaccctcggacgactgcgttagtagaactcaactcctacggacagaaaccgcagagatccacggcgataactacggcggccccggcgacaagattactatctgcaacggcagcaccatcgtcgaccaacgactcggctcagaactaggctgctacaccattaaccgcgtccgcagcttcaaactatgcgagaacagcgcgaccgggaagaactgcgaaatcgactcagtacctgtcaaatgcagacaaggatactgcctgcgaatcacccaagaaggtcgcggacacgtcaagctatcccgcggatcagaagttgttctggacgcgtgcgacaccagttgcgaaatcatgataccaaaaggcaccggtgacattctcgtagactgcagcggcggccaacaacactttttaaaagacaacctcatcgacctcggatgcccaaaaatacctctcctcggtaaaatggctatctacatatgcaggatgtctaaccatcccaaaacaacgatggctttccttttctggttctcctttgggtacgtcataacctgcatactctgcaaagcaatcttctacctcctcatcatcgtagggacactaggacgccgattaaaacagtaccgcgagctaaaaccacaaacatgcacaatttgcgagacaacaccagtcaacgcaatcgatgctgaaatgcacgacctcaactgttcatataacatctgcccctactgcgcctcgcgtctaacctcagacggcctcgccagacacgtcatccaatgccccaagcgcaaggaaaaggtcgaagaaaccgaactatacttgaacctagaacgcatcccgtgggttgtcagaaaactgcttcaggtctcagaatctaccggagtagccctcaagcgctcatcctggctcattgtactgctcgtactctttaccgtgagcttaagcccagtccaatccgcccccatcggccgaaaaccactattcctcgattccacagccaaaggtatgaaaaacctcctcaattcgacctccctcgaaacctccctctcgatcgaagccccctggggcgccataaacgtccaatccacttacaaacctactgtgtctacagcaaatatcgccctatcctggtcttccgtagagcaccgcgggaacaaaatactcgtatctggccgctccgagagcatcatgaagctcgaagaacgcaccggaatctcctgggaccttggcgtagaggatgcgtcagaatcaaagctccttaccgtcagcgtcatggacctatcgcaaatgtactccccagtcttcgaatacctgagcggcgaccgccaggtggaagagtggcccaaagcaacctgcaccggggactgccccgaacggtgcggttgcacttcgtcaacatgccttcacaaagaatggccccacagccggaactggcgctgtaaccccacatggtgctggggcgtcggtaccggatgtacatgctgcggacttgatgtaaaggaccttttcaccgactatatgttcgttaagtggaaggttgaatacatcaaaacagaagcaatagtctgcgtcgagctcacatcccaagagcgtcaatgctccctaatagaagctggaacccgctttaacttaggtccggtcacaataacactatcagaacctcgcaatatccaacaaaagctccctcccgaaatcatcacccttcacccccgcatcgaagaaggattcttcgacctcatgcacgtccaaaaagtgctcagcgccagcacagtctgtaaactccaatcctgtacccacggcgtacccggagacctacaagtttatcacatagggaatctcctaaaaggggacaaagtcaatggccacctcatacacaaaatcgagccacacttcaacaccagctggatgtcctgggacgggtgcgatctagactactactgcaacatgggggactggccctcttgcacctacacgggagtcacacagcacaatcacgcctcattcgtaaaccttctaaacatcgaaacggactacactaaaaatttccacttccactcgaaaagggtcacagcacacggcgacacaccccagctcgacctcaaagcccgccccacctacggcgcaggagaaatcacagtactcgttgaagtagccgacatggagctacataccaagaaaatcgaaatctcaggactcaaatttgcctcactagcctgcacgggctgctacgcatgctcatcttccatctcctgcaaagtacgcatccacgtcgacgaaccagacgagctcaccgtccatgtcaaaagcgatgacccagacgtggtcgccgcttccagctctcttatggctcgaaaactagagttcggcacagactccaccttcaaggctttctcggccatgcccaaaacctcgctctgcttctacatcgttgagcgggagcactgtaaatcctgctccgaagaagataccaaaaagtgcgtcaacaccaaactcgagcaaccgcagtccattctcatcgaacacaaaggcacaatcatcggaaaacaaaacagcacatgcaccgccaaggcatcctgttggcttgaaagcgtgaagtccttcttctacggactcaaaaacatgctatccggcatcttcggcaacgtcttcatgggaatcttcctgtttctggccccctttatactcctaatactcttcttcatgttcggatggcgcatcctcttttgcttcaaatgttgcagacgaacacgcggcctcttcaaataccgccacctcaaagacgacgaagaaacgggctatcgcagaataatcgaaaaattgaacaacaagaaaggcaaaaacaaactcctggacggagaacgattagccgacggcaggatagccgaactattttcaaccaaaacgcacataggttaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17008 - RNA, 1246 nt, synthetic construct
  misc_feature 1..1246: note = mRNA product Design1 comprising derived and/or modified sequence from CCHVF(10200)__U39455.2__IgE-leader_Gn (opt11)
  source 1..1246: mol_type = other RNA
gggagaaagcttaccatggactggacctggatcctcttcctagttgccgccgctacccgcgtccactcctcagaggaaccctccgacgactgcgtctcccgcactcaactcttacgcaccgaaacagccgagatccacggcgacaactacgggggacccggcgacaaaatcaccatatgcaacggctccaccatcgtcgaccaacgcctcggctcagaactcggctgctacacgatcaaccgagtccgctctttcaaactctgtgaaaactcagcaaccggcaaaaactgtgaaatcgactccgtacccgtgaaatgcagacaaggatattgcctccgaatcacccaagaaggacgcggccacgtcaaactcagccgaggctcagaagtcgtcctcgacgcctgcgacacctcatgcgaaatcatgatccccaaaggaaccggcgacatcctcgtcgactgctccggcggccaacaacacttccttaaagacaacctcatagacctcggatgccccaaaatacctctactagggaaaatggccatctacatatgccgcatgtccaaccaccccaaaacaactatggccttccttttctggttctcgttcggctacgtcatcacatgcatcctctgcaaagccatcttttacctacttatcatcgtaggcaccctaggccgccgtctaaaacaataccgcgaactcaaaccccaaacctgcaccatctgcgaaaccacccccgtaaacgccatcgacgcagaaatgcacgacctaaactgctcctacaacatctgcccatactgcgcctcccgcctaacctccgacggactcgcccgccacgtcatccaatgccccaaacgcaaagaaaaagtagaagaaacagaactatacctaaacctagaacgcataccgtgggtcgtccgtaaactcctccaagtctcagaatccaccggcgtcgcactcaaacgatcaagctggctaatcgtcctcctcgtcctcttcaccgtctcactatcccccgtccaatccgcccccatcggctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17009 - RNA, 2206 nt, synthetic construct
  misc_feature 1..2206: note = mRNA product Design1 comprising derived and/or modified sequence from CCHVF(10200)__U39455.2__IgE-leader_Gc (opt11)
  source 1..2206: mol_type = other RNA
gggagaaagcttaccatggactggacctggatcctcttcctcgtcgccgccgcaacacgcgttcacagcttcctcgacagcaccgccaagggcatgaaaaacctactcaactcgacctccctagagacatccctctccatcgaagccccctggggagccatcaacgtccaatccacctacaaaccaaccgtgtccacggccaacatagcgctaagctggtccagcgtcgagcaccgaggaaacaagatcctagtctcgggccgaagcgaatcaataatgaagctcgaggaacgcacgggaatctcatgggatctcggcgtcgaagacgcaagcgaatcaaaactccttacagtgagcgtcatggacctttcacaaatgtactcgcccgtattcgaataccttagcggagaccgccaagttgaagagtggcccaaagcgacctgcaccggcgactgccccgaacgttgtggctgtacatcgagcacatgcctacacaaagaatggccacattccagaaactggcgctgcaacccgacctggtgctggggcgtgggcacaggctgcacatgctgcggccttgacgtcaaagacctattcaccgactacatgttcgtcaaatggaaagtagaatacataaaaaccgaagcaatagtctgcgtcgaactaacctcccaagaacgacaatgctcactcatagaagctggaacccgcttcaacctcggacccgtaacgatcactctctccgaaccccgaaacatccagcaaaaactccctcccgaaatcataaccctacacccacgtatcgaagaaggcttcttcgacctaatgcacgtgcaaaaagtactcagcgcgtccaccgtttgcaaactccaatcttgcactcacggcgtacccggcgacctgcaagtctaccacatcggcaacctcctcaagggcgacaaagtaaatggtcacctgatccacaaaatcgagccccacttcaacacctcctggatgagctgggacggatgcgacctcgactactactgcaacatgggagactggccctcatgcacgtacaccggcgtcacccaacacaaccacgcctcattcgtaaacctgctgaacatcgaaaccgactataccaagaacttccacttccacagcaaaagagtcaccgcccacggcgacacaccccaattagacctcaaagcccgccccacctacggcgccggcgaaataaccgtcctcgtcgaagtcgcagacatggaactacacacaaagaaaatagaaatttccggcctgaaattcgcatcactcgcatgcacaggctgctacgcgtgctcaagctcaatatcctgtaaagtccgaatccacgtagatgaaccagacgagctcaccgtacacgtcaagtcagacgacccagacgtagtagcggcctcatcctccctcatggcacgaaaactagagttcggcacagactcaacattcaaagcattcagcgcaatgccaaaaacctccctttgcttctacatcgtcgaacgcgaacactgcaaaagctgcagcgaagaagacacaaagaaatgcgttaacaccaaacttgaacaaccccaaagcatcctgatagaacacaaaggcactatcatcggaaagcagaactcaacctgcactgccaaggccagctgctggctcgaaagcgtgaaatcattcttttacggactgaaaaacatgctaagcggcattttcggtaacgtattcatgggcatcttcctcttcctggccccgttcatcctcttaatactatttttcatgttcggctggagaatcctattctgtttcaaatgctgccgccgcacgcgcggcctttttaaatatcgccaccttaaggacgatgaagaaaccggctaccgccgaataatagaaaaactaaacaacaaaaagggcaaaaacaaactcctcgacggcgaacgccttgcagacggccgcatagccgaactcttcagcacaaaaacccacataggctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17010 - RNA, 1831 nt, synthetic construct
  misc_feature 1..1831: note = mRNA product Design2 comprising derived and/or modified sequence from CCHFV(10200)__NC_005302.1/U88410.1__N (wt)
  source 1..1831: mol_type = other RNA
ggggcgctgcctacggaggtggcagccatctccttctcggcatcaagcttaccatggaaaacaagatcgaggtgaataacaaagatgagatgaacaggtggtttgaagagttcaaaaaaggaaatggacttgtggacaccttcacaaactcctattccttttgcgagagtgttcccaatttggacaggtttgtgtttcagatggccagtgccaccgatgatgcacagaaggactccatctacgcatctgctctggtggaggcaacaaagttttgtgcacctatatatgagtgcgcatgggttagctccactggcattgtaaaaaagggacttgaatggttcgagaaaaatgcaggaaccattaagtcctgggatgaaagttatactgagctaaaggtcgacgtcccgaaaatagagcagcttaccggttaccaacaagctgccttgaagtggagaaaagacataggtttccgtgtcaatgccaacacagcagctctgagcaacaaagtcctcgcagaatacaaagtccctggtgagattgtgatgtctgtcaaagagatgctgtcagacatgattaggagaaggaacctgattctaaacaggggtggtgatgagaacccacgtggcccagtgagccatgagcatgtagactggtgcagggagtttgtcaaaggcaaatacatcatggccttcaacccaccatggggggacatcaacaagtcaggccgttcaggaatagcacttgttgcaacaggccttgctaagcttgcagagactgaaggaaagggaatatttgatgaagccaaaaagactgtggaggccctcaacgggtatctggacaagcataaggacgaagttgatagagcaagcgccgacagcatgataacaaaccttcttaagcatattgccaaggcacaggagctctataaaaattcatctgcacttcgtgcacaaagcgcacagattgacactgctttcagctcatactattggctttacaaggctggcgtgactcctgaaaccttcccgacggtgtcacagttcctctttgagctagggaaacagccaagaggtaccaagaaaatgaagaaggctcttctgagcaccccaatgaagtgggggaagaagctttatgagctctttgccgatgattctttccagcagaacaggatttacatgcatcctgccgtgcttacagctggtagaatcagtgaaatgggagtctgctttgggacaatccctgtggccaatcctgatgatgctgcccaaggatctggacacactaagtctattctcaacctccgtaccaacactgagaccaataatccgtgtgccaaaaccatcgtcaagctatttgaagttcaaaaaacagggttcaacattcaggacatggacatagtggcctctgagcacttgctacaccaatcccttgttggcaagcaatccccattccagaacgcctacaacgtcaagggcaatgccaccagtgctaacatcatttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17011 - RNA, 1831 nt, synthetic construct
  misc_feature 1..1831: note = mRNA product Design2 comprising derived and/or modified sequence from CCHFV(10200)__NC_005302.1/U88410.1__N (wt)
  source 1..1831: mol_type = other RNA
ggggcgctgcctacggaggtggcagccatctccttctcggcatcaagcttaccatggaaaacaagatcgaggtgaataacaaagatgagatgaacaggtggtttgaagagttcaaaaaaggaaatggacttgtggacaccttcacaaactcctattccttttgcgagagtgttcccaatttggacaggtttgtgtttcagatggccagtgccaccgatgatgcacagaaggactccatctacgcatctgctctggtggaggcaacaaagttttgtgcacctatatatgagtgcgcatgggttagctccactggcattgtaaaaaagggacttgaatggttcgagaaaaatgcaggaaccattaagtcctgggatgaaagttatactgagctaaaggtcgacgtcccgaaaatagagcagcttaccggttaccaacaagctgccttgaagtggagaaaagacataggtttccgtgtcaatgccaacacagcagctctgagcaacaaagtcctcgcagaatacaaagtccctggtgagattgtgatgtctgtcaaagagatgctgtcagacatgattaggagaaggaacctgattctaaacaggggtggtgatgagaacccacgtggcccagtgagccatgagcatgtagactggtgcagggagtttgtcaaaggcaaatacatcatggccttcaacccaccatggggggacatcaacaagtcaggccgttcaggaatagcacttgttgcaacaggccttgctaagctggcagagactgaaggaaagggaatatttgatgaagccaaaaagactgtggaggccctcaacgggtatctggacaagcataaggacgaagttgatagagcaagcgccgacagcatgataacaaaccttcttaagcatattgccaaggcacaggagctctataaaaattcatctgcacttcgtgcacaaagcgcacagattgacactgctttcagctcatactattggctttacaaggctggcgtgactcctgaaaccttcccgacggtgtcacagttcctctttgagctagggaaacagccaagaggtaccaagaaaatgaagaaggctctgctgagcaccccaatgaagtgggggaagaagctgtatgagctctttgccgatgattctttccagcagaacaggatttacatgcatcctgccgtgcttacagctggtagaatcagtgaaatgggagtctgctttgggacaatccctgtggccaatcctgatgatgctgcccaaggatctggacacactaagtctattctcaacctccgtaccaacactgagaccaataatccgtgtgccaaaaccatcgtcaagctatttgaagttcaaaaaacagggttcaacattcaggacatggacatagtggcctctgagcacttgctacaccaatcccttgttggcaagcaatccccattccagaacgcctacaacgtcaagggcaatgccaccagtgctaacatcatttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17012 - RNA, 1831 nt, synthetic construct
  misc_feature 1..1831: note = mRNA product Design2 comprising derived and/or modified sequence from CCHFV(Turkey-Kelkit06)__GQ337053.1__N (wt)
  source 1..1831: mol_type = other RNA
ggggcgctgcctacggaggtggcagccatctccttctcggcatcaagcttaccatggaaaacaagatcgaggtgaacagcaaggatgagatgaacaaatggtttgaggagtttaaaaagggaaatggacttatggacactttcacaaactcctactccttttgtgagaatgtaccaaatctggataagtttgtgttccagatggccagcgccacagatgatgcacagaaggactccatctatgcatcggctctagtggaagcaaccaagttctgtgcacccatatatgaatgtgcttgggtcagctctactggcattgtgaagaaggggcttgagtggttcgagaaggattcaggaactatcaaatcatgggatgagaactatgctgagctgaaggttgatgttcccaaaatagaacaacttgccaattaccaacaggctgctcttaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggctttcaatccaccttggggggacatcaacaaatcaggtcgttcgggaatagcacttgttgcaacaggccttgccaagcttgcagagaccgaggggaaaggagtttttgacgaagctaagaagaccgtggaggctctcaatgggtatttggacaagcacagggacgaagtcgacaaagcaagtgctgacagcatgataacaaacctccctaagcacattgccaaagcacaagagctttataaaaattcatctgctcttcgtgcacaaggtgcacagattgacacccctttcagctcgttttactggctctacaaggccggtgtgactccagagaccttcccaaccatctcacagttcctttttgaactgggggagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatccattgttggcaagcaatctccattccaaaatgcctacaacgtcaagggcaatgccaccagtgccaacatcatctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17013 - RNA, 1831 nt, synthetic construct
  misc_feature 1..1831: note = mRNA product Design2 comprising derived and/or modified sequence from CCHFV(Turkey-Kelkit06)__GQ337053.1__N (wt)
  source 1..1831: mol_type = other RNA
ggggcgctgcctacggaggtggcagccatctccttctcggcatcaagcttaccatggaaaacaagatcgaggtgaacagcaaggatgagatgaacaaatggtttgaggagtttaaaaagggaaatggacttatggacactttcacaaactcctactccttttgtgagaatgtaccaaatctggataagtttgtgttccagatggccagcgccacagatgatgcacagaaggactccatctatgcatcggctctagtggaagcaaccaagttctgtgcacccatatatgaatgtgcttgggtcagctctactggcattgtgaagaaggggcttgagtggttcgagaaggattcaggaactatcaaatcatgggatgagaactatgctgagctgaaggttgatgttcccaaaatagaacaacttgccaattaccaacaggctgctcttaagtggaggaaggacataggtttccgtgtcaacgcaaacacggcagccttaagcaacaaagtccttgcagaatacaaagtccctggtgaaattgtgatgtctgttaaagaaatgctgtcagacatgattagaaggaggaatctaattctcaacaggggcggtgatgaaaatccacgcggcccagtgagccgtgaacatgtggagtggtgcagggaatttgtcaaaggcaagtacatcatggctttcaatccaccttggggggacatcaacaaatcaggtcgttcgggaatagcacttgttgcaacaggccttgccaagctggcagagaccgaggggaaaggagtttttgacgaagctaagaagaccgtggaggctctcaatgggtatttggacaagcacagggacgaagtcgacaaagcaagtgctgacagcatgataacaaacctccctaagcacattgccaaagcacaagagctttataaaaattcatctgctctgcgtgcacaaggtgcacagattgacacccctttcagctcgttttactggctctacaaggccggtgtgactccagagaccttcccaaccatctcacagttcctttttgaactgggggagcagccaagggggaccaaaaaaatgaaaaaggcactcctgagcactccaatgaagtgggggaagaaactttatgagctctttgctgatgactctttccagcagaacagaatctacatgcaccctgctgtgttgacagccggtagaatcagtgaaatgggtgtctgctttggaacaatccctgttgccaatcctgatgatgctgctcagggatctggacataccaagtccattctcaaccttcggacaagcacagagaccaacaatccatgcgccaagacaattgtcaaattatttgaaatccaagaaacaggatttaacatacaggacatggacattgtggcctctgagcacttgctgcaccaatccattgttggcaagcaatctccattccaaaatgcctacaacgtcaagggcaatgccaccagtgccaacatcatctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17014 - RNA, 5437 nt, synthetic construct
  misc_feature 1..5437: note = mRNA product Design2 comprising derived and/or modified sequence from CCHFV(10200)__U39455.2__GP (wt)
  source 1..5437: mol_type = other RNA
ggggcgctgcctacggaggtggcagccatctccttctcggcatcaagcttaccatgcatatatcattaatgtatgcaatcctttgcctacagctgtgtggtctgggagagactcatggatcacacaatgaaactagacacaataaaacagacaccatgacaacacacggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctttagaagattgctttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17015 - RNA, 5437 nt, synthetic construct
  misc_feature 1..5437: note = mRNA product Design2 comprising derived and/or modified sequence from CCHFV(10200)__U39455.2__GP (wt)
  source 1..5437: mol_type = other RNA
ggggcgctgcctacggaggtggcagccatctccttctcggcatcaagcttaccatgcatatatcattaatgtatgcaatcctttgcctacagctgtgtggtctgggagagactcatggatcacacaatgaaactagacacaataaaacagacaccatgacaacacacggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggagatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagagttctttataactggtgagggccattttaatgaagttttacaatttagaacgccaggcacgttgagcaccacagagtcaacccctgctgggctgccaacagctgaaccttttaagtcctacttcgccaaaggcttcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctttagaagattgctttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17016 - RNA, 5437 nt, synthetic construct
  misc_feature 1..5437: note = mRNA product Design2 comprising derived and/or modified sequence from CCHFV(IbAr10200)__AF467768.2__GP (wt)
  source 1..5437: mol_type = other RNA
ggggcgctgcctacggaggtggcagccatctccttctcggcatcaagcttaccatgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggtgatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagaattctttataactggtgagggccattttaatgaagttttacaatttagaacgccaggcacgttgagcaccacagagtcaacacctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctggcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17017 - RNA, 5437 nt, synthetic construct
  misc_feature 1..5437: note = mRNA product Design2 comprising derived and/or modified sequence from CCHFV(IbAr10200)__AF467768.2__GP (wt)
  source 1..5437: mol_type = other RNA
ggggcgctgcctacggaggtggcagccatctccttctcggcatcaagcttaccatgcatatatcattaatgtatgcaatcctttgcctacagctgtgtggtctgggagagactcatggatcacacaatgaaactagacacaataaaacagacaccatgacaacacccggtgataacccgagctctgaaccgccagtgagcacggccttgtctattacacttgacccctccactgtcacacccacaacaccagccagtggattagaaggctcaggggaagtctacacatcccctccgatcaccaccgggagcttgcccctgtcggagacaacaccagaactccctgttacaaccggcacagacaccttaagcgcaggagatgtcgatcccagcacgcagacagccggaggcacctccgcaccaacagtccgcacaagtctacccaacagccctagcacaccatctacaccacaagacacacaccatcctgtgagaaatctactttcagtcacgagtcctgggccagatgaaacatcaacaccctcgggaacaggcaaagagagctcagcaaccagtagccctcatccagtctccaacagaccaccaacccctcctgcaacagcccagggacccactgaaaatgacagtcacaacgccactgaacaccctgagtccctgacacagtcagcaaccccaggcctaatgacctctccaacacagatagtccacccacaaagtgccacccccataaccgttcaagacacacatcccagtccaacgaacaggtctaaaagaaaccttaagatggaaataatcttgactttatctcagggtttaaaaaagtactatgggaaaatattaaggcttctgcaactcaccttagaggaggacactgaaggtctactggaatggtgtaagagaaatcttggtcttgattgtgatgacactttctttcaaaagagaattgaagagttctttataactggtgagggccattttaatgaagttttacaatttagaacgccaggcacgttgagcaccacagagtcaacccctgctgggctgccaacagctgaaccttttaagtcctacttcgccaaaggattcctctcgatagattcaggttactactcagccaaatgttactcaggaacatccaattcagggcttcaattgattaacattacccgacattcaactagaatagttgacacacctgggcctaagatcactaacctaaagaccatcaactgcataaacttgaaggcatcgatcttcaaagaacatagagaggttgaaatcaatgtgcttctcccccaagttgcagttaatctctcaaactgtcacgttgtaatcaaatcacatgtctgtgactactctttagacattgacggtgcggtgaggcttcctcacatttaccatgaaggagttttcatcccaggaacttacaaaatagtgatagataaaaaaaataagttgaatgacagatgcaccttatttaccgactgtgtgataaaaggaagggaggttcgtaaaggacagtcagttttgaggcagtacaagacggaaatcaggattggcaaggcatcaaccggctctagaagattgctttcagaagaacccagtgatgactgtatatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggccattttttacttgttaataattgttggaacactagggaaaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaaaaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtgggagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctggcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatagaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17018 - RNA, 5449 nt, synthetic construct
  misc_feature 1..5449: note = mRNA product Design2 comprising derived and/or modified sequence from CCHFV(Turkey-Kelkit06)__GQ337054.1__GP (wt)
  source 1..5449: mol_type = other RNA
ggggcgctgcctacggaggtggcagccatctccttctcggcatcaagcttaccatgcccaccaacattatgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagcttctgcacctcaccttagaacaggacaccgaaggcctgctagaatggtgtaagggaaaccttgggtcaaactgtgatgatgacttctttcaaaagagaatagaagaattcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagagccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaattccttggattgtcagaaagctattgcaggtgtcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgaaagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagagccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaacaagcttggaaacaagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgctgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagcttcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggtgggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagcttgaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17019 - RNA, 5449 nt, synthetic construct
  misc_feature 1..5449: note = mRNA product Design2 comprising derived and/or modified sequence from CCHFV(Turkey-Kelkit06)__GQ337054.1__GP (wt)
  source 1..5449: mol_type = other RNA
ggggcgctgcctacggaggtggcagccatctccttctcggcatcaagcttaccatgcccaccaacattatgcatacaccattagtgtgcttcattctttacctacagctgttgtgtctaggaggagctcatgggcagttaaacgcaactgaacacaatggaacaaacaacaccacagcacctggcgcaagccaaagccccaagccacccatgagcacaaccccaccacacgcaccggaatcatccaccatcaaacccaccacaccaataagcgaagcagaaggctcaggggaaacgacctcacccccaaacaccacccagggcctgtcctcgccagagaccacatcagaacgccctgcaacaacctccatcagcacgtcaagcacagacagcacgaaccccaccacacagatgaccgacaacacccccacaccaacagtcagcacaagcccatccagcagccccagcacgccatccacaccacaaggcatacatcatcctgcaaggagtctgttgtcagtctcgagccccaagacagtaacaacaccaacaccaacgagccctggagagatgagctcggaaaccagcagtcagcactcagccatgagcagaataccaaccccccacacagcaacccgggtctccactgagatcaccaaccaccgcacacctagacaatctgaatcctcagcacagcagacaaccccaagcccaatgacttccccagcgcaatcgatccttctaatgagtgctgctcctacagctgttcaagacatacatcccagcccaacaaacaggtctaagaggaaccttgagacggaaataattttaactctatctcaaggtctaaagaaatactacggtaagatactgaagctgctgcacctcaccttagaacaggacaccgaaggcctgctagaatggtgtaagggaaaccttgggtcaaactgtgatgatgacttctttcaaaagagaatagaagagttcttcatgactggtgagtgctacttcaatgaagtcttacaatttaaaacactaagcacactaagccccacggagccgtctcatgccaggctaccaacagcagaacccttcaaatcttactttgctaagggcttcctttcaatagattcaggttacttctctgccaaatgttatccaagatcatctgcttcagggcttcagctgatcaatgttacccaacacccagctaggatagcagaaacacctggacccaagacaacaagtctgaaaaccatcaactgtataaacctaagagcatcagtcttcaaagaacacagagaagttgagatcaatgtgcttcttcctcagattgcagtcaacctctcaaactgccatgttgtgatcaattcacatgtctgtgattactctttagacactgatgggccagtgaggcttcctcgcatttatcatgaagggactttcataccaggaacttataaaatagtgatagacaaaaaaaataagctaaatgaccgttgtacactggtcaccaactgtgtgataaagggaagagaggttcgtaaggggcaatcagtgctgaggcagtacaaaacagaaatcaagataggcaaggcatcaacaggctttaggaaactactgtccgaagaaccaggtgatgactgcatatcaagaactcagctattgaggacagaaacagcagagatccatgatgacaactatggtggtccaggtgataaaataactatctgcaacggttcaaccattgtagatcagagactgggcagtgaactagggtgttataccatcaacagggtgaagtcattcaagctatgcaaaaacagcgccacagggaaaacctgtgaggtagacagcactccggttaagtgcaggcaaggtttttgtttaaaaatcacccaagagggaaggggccacgtaaaattatctagaggctcagaggttgtcctggatgcttgcgactcaagctgtgaagtaatgatacctaaaggcactggggatatcctagtggactgttcaggtgggcagcaacatttcttaaaagacaacttaattgacctagggtgcccccatatcccgctattgggtaggatggctatttacatttgcagaatgtcaaatcatcctagaacaaccatggcttttctcttctggttcagctttggctatgttatcacttgtatattttgcaaggctcttttttattcattgataattattggaacactaggaaaaaagatcaagcaatatagggaactgaaacctcaaacctgcaccatatgtgagacagctcctgtcaatgcaatagatgctgaaatgcatgacctcaactgtagttacaatatatgcccttattgtgcatcaagattgacctccgatgggctagccaggcatgtaacgcaatgccccaagcggaaagagaaagttgaggagactgaactgtacctgaacctggaaagaatcccttggattgtcagaaagctattgcaggtctcagagtccactggtgtggcattgaaacgaagcagctggctgattgtactgcttgtgttactgacagtttcgttgtcgccggttcagtcagcacctgttggtcatggaaagacaatcgaaatatatcagaccagggaaggattcgcaagcatctgtctctttatgttaggaagcattctatttatagtctcttgcttggtgaaagggctagttgacagtgtcagtgagagcttcttccccggcctatctgtctgtaagacatgctctattggcagtgtaaatggctttgaaattgaatcgcacaaatgctactgtagcctattttgctgcccctactgtaggcactgctctgctgacagagaaattcaccagttacacttgagtatctgcaaaaaaaggaaaacggggagcaatgtcatgctggccgtctgcaaacgcatgtgctttagggcaaccatagaagcaagcagaagggccctgctcatccgaagcattatcaataccacttttgtaatatgcattctaacattgacaatctgtgttgttagcacctctgcagtggagatggaaaaccttccagcaggaacttgggagagggaggaagatctgacaaatttctgtcatcaggaatgccaggtgactgagacagaatgcctctgtccatacgaagctcttgtgctcagaaaacctcttttcttggacagtatagttaaaggtatgaaaaatttgctaaactcaaccagcttggaaaccagcttatcaattgaggcaccatggggagcaataaatgtccaatcaacctttaaaccaactgtatcgactgcaaacatagcactcagttggagctcagtggtgcacagaggcaacaagatcttggtcacaggcaggtctgaatcaattatgaaactggaggaaaggacaggagtcagctgggatctaggcgtagaagatgcctctgaatccaaattacttaccgtttctatcatggatttgtcacaaatgtattctcctgtttttgagtacttgtcaggagacagacaggttgaagaatggcccaaagcaacttgtacaggtgattgcccggaaaggtgtggttgcacatcatcaacctgcttacataaagaatggtctcactcaagaaactggagatgtaatcccacttggtgctggggagtaggaaccggctgcacctgttgcggggtggatgtaaaagatctttttaccgatcacatgtttgtcaaatggaaagttgaatacataaaaactgaagctatagtatgtgttgcgctcaccagccaagaaagacagtgcagtctgattgaggcaggtactagattcaacttgggccctgtgactattaccctgtctgagccaagaaacattcagcagaagctgcctcctgagattatcacgttgcatcccaaaattgaagaaggcttctttgacttgatgcatgtacaaaaagtgttgtctgcaagtacagtgtgtaaactgcagagttgcacacatggtataccaggagatctacaagtttaccacattggcaacttgttgaaaggggatagagtaaacgggcatctaattcacaaaattgaatcacatttcaacacctcttggatgtcctgggatggttgtgacttagactactactgcaacatgggggattggccatcttgcacatacacaggagtgacccagcataaccatgctgcatttgtaaacttgcttaacattgaaactgattacacgaaaaccttccacttccactctaaaagagtcacagcacatggtgacacaccacaattggacttaaaagcaaggccgacctacggtgcaggagggatcactgtgctggttgaggttgctgacatggagttgcataccaagaaagttgaaatatcaggcttgaaatttgcaagtctggcttgcacgggttgctatgcttgtagctctggcatctcctgtaaagttaggattcatgtagatgaaccagatgagctcacagtacatgtaaagagcagtgatccagatgtggttgcagctagcacaagtctcatggcgaggaagctggaatttgggacagacagcacattcaaggccttttcagctatgcccaaaacctctctatgtttttacattgtggagagagaatactgcaagagctgcagtgaagatgatacacaaaaatgtgttgacacaagacttgagcagccacagagcatactaattgagcacaaaggaacgataattggaaagcagaatgatacttgcacagccaaggcaagctgttggctagagtcagtcaagagttttttttatggattgaagaatatgcttggcagtgtttttggtaatcttttcataggcattttgttattccttgccccttttgtcctgttggtgcttttctttatgtttgggtggaaaatcttgttttgctttaaatgttgcaggaggaccagaggcttatttaagtatagacacctcaaagacgatgaggaaacaggctacagaaggattattgaaagactgaacagcaaaaaagggaaaaacaggctgcttgatggtgatagactggctgataggaaaattgctgagctgttctccacaaaaacacacattggctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17020 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (wt)
  source 1..3961: mol_type = other RNA
ggggcgctgcctacggaggtggcagccatctccttctcggcatcaagcttaccatgcatatatcattaatgtatgcaatcctttgcctacagctgtgtggtctgggagagactcatggatcacacaatgaaacttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17021 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (wt)
  source 1..3961: mol_type = other RNA
ggggcgctgcctacggaggtggcagccatctccttctcggcatcaagcttaccatgcatatatcattaatgtatgcaatcctttgcctacagctgtgtggtctgggagagactcatggatcacacaatgaaacttcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17022 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (wt)
  source 1..3934: mol_type = other RNA
ggggcgctgcctacggaggtggcagccatctccttctcggcatcaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17023 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (wt)
  source 1..3934: mol_type = other RNA
ggggcgctgcctacggaggtggcagccatctccttctcggcatcaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtcaagggaagacaattgaggcataccgggccagggaagggtacacaagtatatgcctctttgtactaggaagtatcctatttatagtttcttgcctaatgaaagggctggttgacagtgttggcaactccttcttccctggactgtccatttgcaaaacgtgctccataagcagcattaatggctttgaaattgagtcccataagtgctattgcagcttattctgttgcccctattgtaggcactgctctaccgataaagaaattcataagctgcacttgagcatctgcaaaaaaaggaaaacaggaagtaatgtcatgttggctgtctgcaagctcatgtgtttcagggccaccatggaagtaagtaacagagccctgtttatccgtagcatcatcaacaccacttttgttttgtgcatactgatactagcagtttgtgttgttagcacctcagcagtggagatggaaaacctaccagcagggacctgggaaagagaagaagacctaacaaatttctgtcatcaggaatgccaggttacagagactgaatgcctctgcccttatgaagctctagtactcagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17024 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (wt)
  source 1..3355: mol_type = other RNA
ggggcgctgcctacggaggtggcagccatctccttctcggcatcaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17025 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (wt)
  source 1..3355: mol_type = other RNA
ggggcgctgcctacggaggtggcagccatctccttctcggcatcaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggtagaaagcctttattcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17026 - RNA, 1411 nt, synthetic construct
  misc_feature 1..1411: note = mRNA product Design2 comprising derived and/or modified sequence from CCHVF(10200)__U39455.2__IgE-leader_Gn (wt)
  source 1..1411: mol_type = other RNA
ggggcgctgcctacggaggtggcagccatctccttctcggcatcaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaattccttgggttgtaagaaagctgttgcaggtgtcagagtcaactggtgtggcattgaaaagaagcagttggctgattgtgctgcttgtgctattcactgtttcattatcaccagttcaatcagcacccattggttagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17027 - RNA, 1411 nt, synthetic construct
  misc_feature 1..1411: note = mRNA product Design2 comprising derived and/or modified sequence from CCHVF(10200)__U39455.2__IgE-leader_Gn (wt)
  source 1..1411: mol_type = other RNA
ggggcgctgcctacggaggtggcagccatctccttctcggcatcaagcttaccatggactggacctggatcctgttcctcgtggccgccgcgacccgcgtccacagctcagaagaacccagtgatgactgtgtatcaagaactcaactattaaggacagagactgcagagatccacggcgacaactatggtggcccgggtgacaaaataaccatctgcaatggctcaactattgtagaccaaagactgggcagtgaactaggatgctacaccatcaatagagtgaggtcattcaagctatgcgaaaacagtgccacagggaagaattgtgaaatagacagtgtcccagttaaatgcaggcagggttattgcctaagaatcactcaggaagggaggggccacgtaaaattatctaggggctcagaggttgtcttagatgcatgcgatacaagctgtgaaataatgatacctaagggcactggtgacatcctagttgactgttcaggtgggcagcaacattttctaaaggacaatttgatagatctaggatgccccaaaattccattattgggcaaaatggctatttacatttgcagaatgtcaaaccaccccaaaacaaccatggctttcctcttctggttcagctttggctatgtaataacctgcatactttgcaaggctattttttacttgttaataattgttggaacactagggagaaggctcaagcagtatagagagttgaaacctcagacttgcaccatatgtgagacaactcctgtaaatgcaatagatgctgagatgcatgacctcaattgcagttacaacatttgtccctactgtgcatctagactaacctcagatgggcttgctaggcatgtgatacaatgccctaagcggaaggagaaagtggaagaaactgaactgtacttgaacttagaaagaatcccttgggttgtaagaaagctgttgcaggtctcagagtcaactggtgtggcattgaaaagaagcagttggctgattgtgctgcttgtgctattcactgtttcattatcaccagttcaatcagcacccattggttagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17028 - RNA, 2371 nt, synthetic construct
  misc_feature 1..2371: note = mRNA product Design2 comprising derived and/or modified sequence from CCHVF(10200)__U39455.2__IgE-leader_Gc (wt)
  source 1..2371: mol_type = other RNA
ggggcgctgcctacggaggtggcagccatctccttctcggcatcaagcttaccatggactggacctggatcctgttcctcgtggccgccgcgacccgcgtccacagcttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttactagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgcaagcttagcttgcacaggttgttatgcttgtagctctagcatctcatgcaaagttagaattcatgtggatgaaccagatgaacttacagtacatgttaaaagtgatgatccagatgtggttgcagctagctcaagtctcatggcaaggaagcttgaatttggaacagacagtacatttaaagctttctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17029 - RNA, 2371 nt, synthetic construct
  misc_feature 1..2371: note = mRNA product Design2 comprising derived and/or modified sequence from CCHVF(10200)__U39455.2__IgE-leader_Gc (wt)
  source 1..2371: mol_type = other RNA
ggggcgctgcctacggaggtggcagccatctccttctcggcatcaagcttaccatggactggacctggatcctgttcctcgtggccgccgcgacccgcgtccacagcttcctagatagtacagctaaaggcatgaaaaatctgctaaattcaacaagtttagaaacgagtttatcaattgaggcaccatggggagcaataaatgttcagtcaacctacaaaccaactgtgtcaactgcaaacatagcactcagttggagctcagtggaacacagaggcaataagatcttggtttcaggcagatcagaatcaattatgaagctggaagaaaggacaggaatcagctgggatctcggtgtagaagatgcctctgaatctaaactgcttacagtatctgtcatggacttgtctcagatgtactctcctgtcttcgagtacttatcaggggacagacaggtggaagagtggcccaaagcaacttgcacaggtgactgcccagaaagatgtggctgcacatcatcaacctgtttgcacaaagaatggcctcactcaagaaattggagatgcaatcccacttggtgctggggtgtagggactggctgcacctgttgtggattagatgtgaaagacctttttacagattatatgtttgtcaagtggaaagttgaatacatcaagacagaggccatagtgtgtgtagaacttacaagtcaggaaaggcagtgtagcttgattgaagcgggcacaaggttcaatttaggtcctgtgaccatcacactgtcagaaccaagaaacatccaacaaaaactccctcctgaaataatcacactgcatcctaggatcgaagaaggtttttttgacctgatgcatgtgcaaaaggtgttatcggcaagcacagtgtgtaagttgcagagttgcacacatggtgtgccaggagacctacaggtctaccacatcggaaatttattaaaaggggataaggtaaatggacatctaattcataaaattgagccacacttcaacacctcctggatgtcctgggatggttgtgacctagactactactgcaacatgggagattggccttcttgcacatacacaggggtcacccaacacaatcatgcttcatttgtaaacttactcaacattgaaactgattacacaaagaacttccactttcactctaaaagggtcactgcacacggagatacaccacaactagatcttaaggcaagaccaacctatggtgcaggcgagatcactgttctggtagaagttgctgacatggagttacatacaaagaagattgaaatatcaggcttaaaatttgccagcttagcttgcacaggttgttatgcttgtagctctagcatctcatgcaaagttagaatccatgtggatgaaccagatgaacttacagtacatgttaaaagtgatgatccagatgtggttgcagctagctcaagtctcatggcaaggaagctggaatttggaacagacagtacatttaaagcattctcggccatgcctaaaacttctctatgtttctacattgttgaaagagaacactgtaagagctgcagtgaagaagacacaaaaaaatgtgttaacacaaaacttgagcaaccacaaagcattttgatcgaacacaagggaactataatcggaaagcaaaacagcacttgcacggctaaggcaagttgctggttagagtcagtcaagagttttttttatggcctaaagaacatgcttagtggcatttttggcaatgtctttatgggcattttcttgttccttgcccccttcatcctgttaatactattctttatgtttgggtggaggatcctattctgctttaaatgttgtagaagaaccagaggcctgttcaagtatagacacctcaaagacgatgaagaaactggttatagaaggattattgaaaaactaaacaataaaaaaggaaaaaacaaactgcttgatggtgaaagacttgctgatggaagaattgccgaactgttctctacaaaaacacacattggctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17030 - RNA, 1831 nt, synthetic construct
  misc_feature 1..1831: note = mRNA product Design2 comprising derived and/or modified sequence from CCHFV(10200)__NC_005302.1/U88410.1__N (opt4)
  source 1..1831: mol_type = other RNA
ggggcgctgcctacggaggtggcagccatctccttctcggcatcaagcttaccatggagaacaagatcgaggtgaacaacaaggacgagatgaacagatggttcgaggagttcaagaagggcaacggcctggtggacaccttcaccaacagctacagcttctgcgagagcgtgcccaacctggacagattcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaagaacgccggcaccatcaagagctgggacgagagctacaccgagctgaaggtggacgtgcccaagatcgagcagctgaccggctaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagccacgagcacgtggactggtgcagagagttcgtgaagggcaagtacatcatggccttcaaccccccctggggcgacatcaacaagagcggcagaagcggcatcgccctggtggccaccggcctggccaagctggccgagaccgagggcaagggcatcttcgacgaggccaagaagaccgtggaggccctgaacggctacctggacaagcacaaggacgaggtggacagagccagcgccgacagcatgatcaccaacctgctgaagcacatcgccaaggcccaggagctgtacaagaacagcagcgccctgagagcccagagcgcccagatcgacaccgccttcagcagctactactggctgtacaaggccggcgtgacccccgagaccttccccaccgtgagccagttcctgttcgagctgggcaagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccaacaccgagaccaacaacccctgcgccaagaccatcgtgaagctgttcgaggtgcagaagaccggcttcaacatccaggacatggacatcgtggccagcgagcatctgctgcaccagagcctggtgggcaagcagagccccttccagaacgcctacaacgtgaagggcaacgccaccagcgccaacatcatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17031 - RNA, 1831 nt, synthetic construct
  misc_feature 1..1831: note = mRNA product Design2 comprising derived and/or modified sequence from CCHFV(Turkey-Kelkit06)__GQ337053.1__N (opt4)
  source 1..1831: mol_type = other RNA
ggggcgctgcctacggaggtggcagccatctccttctcggcatcaagcttaccatggagaacaagatcgaggtgaacagcaaggacgagatgaacaagtggttcgaggagttcaagaagggcaacggcctgatggacaccttcaccaacagctacagcttctgcgagaacgtgcccaacctggacaagttcgtgttccagatggccagcgccaccgacgacgcccagaaggacagcatctacgccagcgccctggtggaggccaccaagttctgcgcccccatctacgagtgcgcctgggtgagcagcaccggcatcgtgaagaagggcctggagtggttcgagaaggacagcggcaccatcaagagctgggacgagaactacgccgagctgaaggtggacgtgcccaagatcgagcagctggccaactaccagcaggccgccctgaagtggagaaaggacatcggcttcagagtgaacgccaacaccgccgccctgagcaacaaggtgctggccgagtacaaggtgcccggcgagatcgtgatgagcgtgaaggagatgctgagcgacatgatcagaagaagaaacctgatcctgaacagaggcggcgacgagaaccccagaggccccgtgagcagagagcacgtggagtggtgcagagagttcgtgaagggcaagtacatcatggccttcaaccccccctggggcgacatcaacaagagcggcagaagcggcatcgccctggtggccaccggcctggccaagctggccgagaccgagggcaagggcgtgttcgacgaggccaagaagaccgtggaggccctgaacggctacctggacaagcacagagacgaggtggacaaggccagcgccgacagcatgatcaccaacctgcccaagcacatcgccaaggcccaggagctgtacaagaacagcagcgccctgagagcccagggcgcccagatcgacacccccttcagcagcttctactggctgtacaaggccggcgtgacccccgagaccttccccaccatcagccagttcctgttcgagctgggcgagcagcccagaggcaccaagaagatgaagaaggccctgctgagcacccccatgaagtggggcaagaagctgtacgagctgttcgccgacgacagcttccagcagaacagaatctacatgcaccccgccgtgctgaccgccggcagaatcagcgagatgggcgtgtgcttcggcaccatccccgtggccaaccccgacgacgccgcccagggcagcggccacaccaagagcatcctgaacctgagaaccagcaccgagaccaacaacccctgcgccaagaccatcgtgaagctgttcgagatccaggagaccggcttcaacatccaggacatggacatcgtggccagcgagcatctgctgcaccagagcatcgtgggcaagcagagccccttccagaacgcctacaacgtgaagggcaacgccaccagcgccaacatcatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17032 - RNA, 5437 nt, synthetic construct
  misc_feature 1..5437: note = mRNA product Design2 comprising derived and/or modified sequence from CCHFV(10200)__U39455.2__GP (opt4)
  source 1..5437: mol_type = other RNA
ggggcgctgcctacggaggtggcagccatctccttctcggcatcaagcttaccatgcacatcagcctgatgtacgccatcctgtgcctgcagctgtgcggcctgggcgagacccacggcagccacaacgagaccagacacaacaagaccgacaccatgaccacccacggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcttcagaagactgctgagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17033 - RNA, 5437 nt, synthetic construct
  misc_feature 1..5437: note = mRNA product Design2 comprising derived and/or modified sequence from CCHFV(IbAr10200)__AF467768.2__GP (opt4)
  source 1..5437: mol_type = other RNA
ggggcgctgcctacggaggtggcagccatctccttctcggcatcaagcttaccatgcacatcagcctgatgtacgccatcctgtgcctgcagctgtgcggcctgggcgagacccacggcagccacaacgagaccagacacaacaagaccgacaccatgaccacccccggcgacaaccccagcagcgagccccccgtgagcaccgccctgagcatcaccctggaccccagcaccgtgacccccaccacccccgccagcggcctggagggcagcggcgaggtgtacaccagcccccccatcaccaccggcagcctgcccctgagcgagaccacccccgagctgcccgtgaccaccggcaccgacaccctgagcgccggcgacgtggaccccagcacccagaccgccggcggcaccagcgcccccaccgtgagaaccagcctgcccaacagccccagcacccccagcaccccccaggacacccaccaccccgtgagaaacctgctgagcgtgaccagccccggccccgacgagaccagcacccccagcggcaccggcaaggagagcagcgccaccagcagcccccaccccgtgagcaacagaccccccaccccccccgccaccgcccagggccccaccgagaacgacagccacaacgccaccgagcaccccgagagcctgacccagagcgccacccccggcctgatgaccagccccacccagatcgtgcacccccagagcgccacccccatcaccgtgcaggacacccaccccagccccaccaacagaagcaagagaaacctgaagatggagatcatcctgaccctgagccagggcctgaagaagtactacggcaagatcctgagactgctgcagctgaccctggaggaggacaccgagggcctgctggagtggtgcaagagaaacctgggcctggactgcgacgacaccttcttccagaagagaatcgaggagttcttcatcaccggcgagggccacttcaacgaggtgctgcagttcagaacccccggcaccctgagcaccaccgagagcacccccgccggcctgcccaccgccgagcccttcaagagctacttcgccaagggcttcctgagcatcgacagcggctactacagcgccaagtgctacagcggcaccagcaacagcggcctgcagctgatcaacatcaccagacacagcaccagaatcgtggacacccccggccccaagatcaccaacctgaagaccatcaactgcatcaacctgaaggccagcatcttcaaggagcacagagaggtggagatcaacgtgctgctgccccaggtggccgtgaacctgagcaactgccacgtggtgatcaagagccacgtgtgcgactacagcctggacatcgacggcgccgtgagactgccccacatctaccacgagggcgtgttcatccccggcacctacaagatcgtgatcgacaagaagaacaagctgaacgacagatgcaccctgttcaccgactgcgtgatcaagggcagagaggtgagaaagggccagagcgtgctgagacagtacaagaccgagatcagaatcggcaaggccagcaccggcagcagaagactgctgagcgaggagcccagcgacgactgcatcagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcaagagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaagggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtgggcgagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcggcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacagaagaatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17034 - RNA, 5449 nt, synthetic construct
  misc_feature 1..5449: note = mRNA product Design2 comprising derived and/or modified sequence from CCHFV(Turkey-Kelkit06)__GQ337054.1__GP (opt4)
  source 1..5449: mol_type = other RNA
ggggcgctgcctacggaggtggcagccatctccttctcggcatcaagcttaccatgcccaccaacatcatgcacacccccctggtgtgcttcatcctgtacctgcagctgctgtgcctgggcggcgcccacggccagctgaacgccaccgagcacaacggcaccaacaacaccaccgcccccggcgccagccagagccccaagccccccatgagcaccacccccccccacgcccccgagagcagcaccatcaagcccaccacccccatcagcgaggccgagggcagcggcgagaccaccagcccccccaacaccacccagggcctgagcagccccgagaccaccagcgagagacccgccaccaccagcatcagcaccagcagcaccgacagcaccaaccccaccacccagatgaccgacaacacccccacccccaccgtgagcaccagccccagcagcagccccagcacccccagcaccccccagggcatccaccaccccgccagaagcctgctgagcgtgagcagccccaagaccgtgaccacccccacccccaccagccccggcgagatgagcagcgagaccagcagccagcacagcgccatgagcagaatccccaccccccacaccgccaccagagtgagcaccgagatcaccaaccacagaacccccagacagagcgagagcagcgcccagcagaccacccccagccccatgaccagccccgcccagagcatcctgctgatgagcgccgcccccaccgccgtgcaggacatccaccccagccccaccaacagaagcaagagaaacctggagaccgagatcatcctgaccctgagccagggcctgaagaagtactacggcaagatcctgaagctgctgcacctgaccctggagcaggacaccgagggcctgctggagtggtgcaagggcaacctgggcagcaactgcgacgacgacttcttccagaagagaatcgaggagttcttcatgaccggcgagtgctacttcaacgaggtgctgcagttcaagaccctgagcaccctgagccccaccgagcccagccacgccagactgcccaccgccgagcccttcaagagctacttcgccaagggcttcctgagcatcgacagcggctacttcagcgccaagtgctaccccagaagcagcgccagcggcctgcagctgatcaacgtgacccagcaccccgccagaatcgccgagacccccggccccaagaccaccagcctgaagaccatcaactgcatcaacctgagagccagcgtgttcaaggagcacagagaggtggagatcaacgtgctgctgccccagatcgccgtgaacctgagcaactgccacgtggtgatcaacagccacgtgtgcgactacagcctggacaccgacggccccgtgagactgcccagaatctaccacgagggcaccttcatccccggcacctacaagatcgtgatcgacaagaagaacaagctgaacgacagatgcaccctggtgaccaactgcgtgatcaagggcagagaggtgagaaagggccagagcgtgctgagacagtacaagaccgagatcaagatcggcaaggccagcaccggcttcagaaagctgctgagcgaggagcccggcgacgactgcatcagcagaacccagctgctgagaaccgagaccgccgagatccacgacgacaactacggcggccccggcgacaagatcaccatctgcaacggcagcaccatcgtggaccagagactgggcagcgagctgggctgctacaccatcaacagagtgaagagtttcaagctgtgcaagaacagcgccaccggcaagacctgcgaggtggacagcacccccgtgaagtgcagacagggcttctgcctgaagatcacccaggagggcagaggccacgtgaagctgagcagaggcagcgaggtggtgctggacgcctgcgacagcagctgcgaggtgatgatccccaagggcaccggcgacatcctggtggactgcagcggcggccagcagcacttcctgaaggacaacctgatcgacctgggctgcccccacatccccctgctgggcagaatggccatctacatctgcagaatgagcaaccaccccagaaccaccatggccttcctgttctggttcagcttcggctacgtgatcacctgtatcttctgcaaggccctgttctacagcctgatcatcatcggcaccctgggcaagaagatcaagcagtacagagagctgaagccccagacctgcaccatctgcgagaccgcccccgtgaacgccatcgacgccgagatgcacgacctgaactgcagctacaacatctgcccctactgcgccagcagactgaccagcgacggcctggccagacacgtgacccagtgccccaagagaaaggagaaggtggaggagaccgagctgtacctgaacctggagagaatcccctggatcgtgagaaagctgctgcaggtcagcgagagcaccggcgtggccctgaagagaagcagctggctgatcgtgctgctggtgctgctgaccgtgagcctgagccccgtgcagagcgcccccgtgggccacggcaagaccatcgagatctaccagaccagagagggcttcgccagcatctgcctgttcatgctgggcagcatcctgttcatcgtgagctgcctggtgaagggcctggtggacagcgtgagcgagagcttcttccccggcctgagcgtgtgcaagacctgcagcatcggcagcgtgaacggcttcgagatcgagagccacaagtgctactgcagcctgttctgctgcccctactgcagacactgcagcgccgacagagagatccaccagctgcacctgagcatctgcaagaagagaaagaccggcagcaacgtgatgctggccgtgtgcaagagaatgtgcttcagagccaccatcgaggccagcagaagggccctgctgatcagaagcatcatcaacaccaccttcgtgatctgcatcctgaccctgaccatctgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcatcgtgaagggcatgaagaacctgctgaacagcaccagcctggagaccagcctgagcatcgaggccccctggggcgccatcaacgtgcagagcaccttcaagcccaccgtgagcaccgccaacatcgccctgagctggagcagcgtggtgcacagaggcaacaagatcctggtgaccggcagaagcgagagcatcatgaagctggaggagagaaccggcgtgagctgggacctgggcgtggaggacgccagcgagagcaagctgctgaccgtgagcatcatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggagccacagcagaaactggagatgcaaccccacctggtgctggggcgtgggcaccggctgcacctgttgcggcgtggacgtgaaggacctgttcaccgaccacatgttcgtgaagtggaaggtggagtacatcaagaccgaggccatcgtgtgcgtggccctgaccagccaggagagacagtgcagcctgatcgaggccggcaccagattcaacctgggccccgtgaccatcaccctgagcgagcccagaaacatccagcagaagctgccccccgagatcatcaccctgcaccccaagatcgaggagggcttcttcgacctgatgcacgtgcagaaggtgctgagcgccagcaccgtgtgcaagctgcagagctgcacccacggcatccccggcgacctgcaggtctaccacatcggcaacctgctgaagggcgacagagtgaacggccacctgatccacaagatcgagagccacttcaacaccagctggatgagctgggacggctgcgacctggactactactgcaacatgggcgactggcccagctgcacctacaccggcgtgacccagcacaaccacgccgccttcgtgaacctgctgaacatcgagaccgactacaccaagaccttccacttccacagcaagagagtgaccgcccacggcgacaccccccagctggacctgaaggccagacccacctacggcgccggcggcatcaccgtgctggtggaggtggccgacatggagctgcacaccaagaaggtggagatcagcggcctgaagttcgccagcctggcctgcaccggctgctacgcctgcagcagcggcatcagctgcaaggtgagaatccacgtggacgagcccgacgagctgaccgtgcacgtgaagagtagcgaccccgacgtggtggccgccagcaccagcctgatggccagaaagctggagttcggcaccgacagcaccttcaaggccttcagcgccatgcccaagaccagcctgtgcttctacatcgtggagagagagtactgcaagagctgcagcgaggacgacacccagaagtgcgtggacaccagactggagcagccccagagcatcctgatcgagcacaagggcaccatcatcggcaagcagaacgacacctgtaccgccaaggccagctgctggctggagagcgtgaagagtttcttctacggcctgaagaacatgctgggcagcgtgttcggcaacctgttcatcggcatcctgctgttcctggcccccttcgtgctgctggtgctgttcttcatgttcggctggaagatcctgttctgcttcaagtgctgcagaagaaccagaggcctgttcaagtacagacacctgaaggacgacgaggagaccggctacagaagaatcatcgagagactgaacagcaagaagggcaagaacagactgctggacggcgacagactggccgacagaaagatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17035 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (opt4)
  source 1..3961: mol_type = other RNA
ggggcgctgcctacggaggtggcagccatctccttctcggcatcaagcttaccatgcacatcagcctgatgtacgccatcctgtgcctgcagctgtgcggcctgggcgagacccacggcagccacaacgagaccagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17036 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (opt4)
  source 1..3934: mol_type = other RNA
ggggcgctgcctacggaggtggcagccatctccttctcggcatcaagcttaccatggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggccagggcaagaccatcgaggcctacagagccagagagggctacaccagcatctgcctgttcgtgctgggcagcatcctgttcatcgtgagctgcctgatgaagggcctggtggacagcgtgggcaacagcttcttccccggcctgagcatctgcaagacctgcagcatcagcagcatcaacggcttcgagatcgagagccacaagtgctactgcagcctgttctgctgcccctactgcagacactgcagcaccgacaaggagatccacaagctgcacctgagcatctgcaagaagagaaagaccggcagcaacgtgatgctggccgtgtgcaagctgatgtgcttcagagccaccatggaggtgagcaacagagccctgttcatcagaagcatcatcaacaccaccttcgtgctgtgcatcctgatcctggccgtgtgcgtggtgagcaccagcgccgtggagatggagaacctgcccgccggcacctgggagagagaggaggacctgaccaacttctgccaccaggagtgccaggtgaccgagaccgagtgcctgtgcccctacgaggccctggtgctgagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17037 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (opt4)
  source 1..3355: mol_type = other RNA
ggggcgctgcctacggaggtggcagccatctccttctcggcatcaagcttaccatggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggcagaaagcccctgttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17038 - RNA, 1411 nt, synthetic construct
  misc_feature 1..1411: note = mRNA product Design2 comprising derived and/or modified sequence from CCHVF(10200)__U39455.2__IgE-leader_Gn (opt4)
  source 1..1411: mol_type = other RNA
ggggcgctgcctacggaggtggcagccatctccttctcggcatcaagcttaccatggactggacctggatcctgttcctggtggccgccgccaccagagtgcacagcagcgaggagcccagcgacgactgcgtgagcagaacccagctgctgagaaccgagaccgccgagatccacggcgacaactacggcggccccggcgacaagatcaccatctgcaacggcagcaccatcgtggaccagagactgggcagcgagctgggctgctacaccatcaacagagtgaggagcttcaagctgtgcgagaacagcgccaccggcaagaactgcgagatcgacagcgtgcccgtgaagtgcagacagggctactgcctgagaatcacccaggagggcagaggccacgtgaagctgagcagaggcagcgaggtggtgctggacgcctgcgacaccagctgcgagatcatgatccccaagggcaccggcgacatcctggtggactgcagcggcggccagcagcacttcctgaaggacaacctgatcgacctgggctgccccaagatccccctgctgggcaagatggccatctacatctgcagaatgagcaaccaccccaagaccaccatggccttcctgttctggttcagcttcggctacgtgatcacctgtatcctgtgcaaggccatcttctacctgctgatcatcgtgggcaccctgggcagaagactgaagcagtacagagagctgaagccccagacctgcaccatctgcgagaccacccccgtgaacgccatcgacgccgagatgcacgacctgaactgcagctacaacatctgcccctactgcgccagcagactgaccagcgacggcctggccagacacgtgatccagtgccccaagagaaaggagaaggtggaggagaccgagctgtacctgaacctggagagaatcccctgggtggtgagaaagctgctgcaggtcagcgagagcaccggcgtggccctgaagagaagcagctggctgatcgtgctgctggtgctgttcaccgtgagcctgagccccgtgcagagcgcccccatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17039 - RNA, 2371 nt, synthetic construct
  misc_feature 1..2371: note = mRNA product Design2 comprising derived and/or modified sequence from CCHVF(10200)__U39455.2__IgE-leader_Gc (opt4)
  source 1..2371: mol_type = other RNA
ggggcgctgcctacggaggtggcagccatctccttctcggcatcaagcttaccatggactggacctggatcctgttcctggtggccgccgccaccagagtgcacagcttcctggacagcaccgccaagggcatgaagaacctgctgaacagcaccagcctggagaccagcctgagcatcgaggccccctggggcgccatcaacgtgcagagcacctacaagcccaccgtgagcaccgccaacatcgccctgagctggagcagcgtggagcacagaggcaacaagatcctggtgagcggcagaagcgagagcatcatgaagctggaggagagaaccggcatcagctgggacctgggcgtggaggacgccagcgagagcaagctgctgaccgtgagcgtgatggacctgagccagatgtacagccccgtgttcgagtacctgagcggcgacagacaggtggaggagtggcccaaggccacctgtaccggcgactgccccgagagatgcggctgcaccagcagcacctgtctgcacaaggagtggccccacagcagaaactggagatgcaaccccacctggtgctggggcgtgggcaccggctgcacctgttgcggcctggacgtgaaggacctgttcaccgactacatgttcgtgaagtggaaggtggagtacatcaagaccgaggccatcgtgtgcgtggagctgaccagccaggagagacagtgcagcctgatcgaggccggcaccagattcaacctgggccccgtgaccatcaccctgagcgagcccagaaacatccagcagaagctgccccccgagatcatcaccctgcaccccagaatcgaggagggcttcttcgacctgatgcacgtgcagaaggtgctgagcgccagcaccgtgtgcaagctgcagagctgcacccacggcgtgcccggcgacctgcaggtctaccacatcggcaacctgctgaagggcgacaaggtgaacggccacctgatccacaagatcgagccccacttcaacaccagctggatgagctgggacggctgcgacctggactactactgcaacatgggcgactggcccagctgcacctacaccggcgtgacccagcacaaccacgccagcttcgtgaacctgctgaacatcgagaccgactacaccaagaacttccacttccacagcaagagagtgaccgcccacggcgacaccccccagctggacctgaaggccagacccacctacggcgccggcgagatcaccgtgctggtggaggtggccgacatggagctgcacaccaagaagatcgagatcagcggcctgaagttcgccagcctggcctgcaccggctgctacgcctgcagcagcagcatcagctgcaaggtgagaatccacgtggacgagcccgacgagctgaccgtgcacgtgaagagtgacgaccccgacgtggtggccgccagcagcagcctgatggccagaaagctggagttcggcaccgacagcaccttcaaggccttcagcgccatgcccaagaccagcctgtgcttctacatcgtggagagagagcactgcaagagctgcagcgaggaggacaccaagaagtgcgtgaacaccaagctggagcagccccagagcatcctgatcgagcacaagggcaccatcatcggcaagcagaacagcacctgtaccgccaaggccagctgctggctggagagcgtgaagagtttcttctacggcctgaagaacatgctgagcggcatcttcggcaacgtgttcatgggcatcttcctgttcctggcccccttcatcctgctgatcctgttcttcatgttcggctggagaatcctgttctgcttcaagtgctgcagaagaaccagaggcctgttcaagtacagacacctgaaggacgacgaggagaccggctacagaagaatcatcgagaagctgaacaacaagaagggcaagaacaagctgctggacggcgagagactggccgacggcagaatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17040 - RNA, 1831 nt, synthetic construct
  misc_feature 1..1831: note = mRNA product Design2 comprising derived and/or modified sequence from CCHFV(10200)__NC_005302.1/U88410.1__N (opt3)
  source 1..1831: mol_type = other RNA
ggggcgctgcctacggaggtggcagccatctccttctcggcatcaagcttaccatggagaacaagatcgaagtgaataacaaagacgagatgaatagatggttcgaagagtttaagaaaggcaacgggctggtcgataccttcacaaatagctactccttttgcgaatctgttcccaacctcgacaggttcgtgtttcagatggcctcagctactgatgacgcacaaaaggatagtatttatgccagcgcgcttgtagaggctacgaaattctgtgcccctatatacgagtgcgcatgggtgtcctctaccggaatcgtcaagaagggtctggaatggtttgagaaaaatgccggcacaattaagtcgtgggacgaatcatatactgagttgaaagtggatgttccaaagatcgagcagttaaccgggtaccagcaggctgcactgaaatggcggaaggacattggattccgcgtgaacgccaatacagctgccctaagcaacaaggtcctcgcggaatataaagtgccgggcgagatcgtaatgagtgttaaggaaatgctgtccgatatgatacgacgtagaaatcttatcctgaacaggggtggggacgagaatccccggggacctgtgtctcacgaacatgtcgattggtgtcgcgagtttgtgaaaggcaagtacattatggcattcaacccaccctggggcgacatcaataaaagcgggagatccggaattgccttggtggctaccggtctcgccaagctggcagagactgaaggcaaagggatctttgatgaggctaagaagacagtcgaagccctgaacggatatctcgacaaacacaaggacgaggttgatagggcgtcagccgacagtatgataaccaacttactgaaacatattgcaaaggctcaagaactttacaaaaatagctctgccttgcgggctcagtccgcccagatcgatacggcattctcaagctactattggctgtacaaggccggcgtgactcctgagacctttccaacagtaagtcagttcctattcgagctcggtaagcaaccccgcgggactaaaaagatgaaaaaggctctgctttctacccctatgaaatggggaaagaagctgtatgaattgtttgcggacgattccttccagcagaaccgaatttacatgcacccagcagtgctcacagccggcagaatcagcgagatgggcgtctgctttgggaccatcccggtggctaatcccgacgatgccgcacagggatcgggtcatacgaaatctattctgaacttaaggactaatacagaaaccaacaatccttgtgccaagactatagttaaactgttcgaggtgcaaaagacaggctttaacatccaggacatggatattgtcgcttccgaacacctccttcaccagtcactggtggggaaacaaagtccattccagaatgcctataacgtaaagggaaatgcaaccagcgcgaacatcatatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17041 - RNA, 1831 nt, synthetic construct
  misc_feature 1..1831: note = mRNA product Design2 comprising derived and/or modified sequence from CCHFV(Turkey-Kelkit06)__GQ337053.1__N (opt3)
  source 1..1831: mol_type = other RNA
ggggcgctgcctacggaggtggcagccatctccttctcggcatcaagcttaccatggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggcctcagctactgatgacgcacaaaaggatagtatttatgccagcgcgcttgtggaggctacgaagttctgtgcccctatatacgagtgcgcatgggtatcctctaccggaatcgtgaaaaagggtctggaatggtttgagaaagactcgggcacaattaagtcatgggatgaaaattatgccgagttgaaagtcgacgtgccaaagatcgagcagttagctaactaccagcaggcagccctgaagtggagaaaagatattgggttcagggttaatgctaacactgccgcgctaagcaataaggtgctcgcagaatataaagtcccgggagagatcgtgatgagtgtaaaggaaatgctgtccgacatgatacggcgccgaaaccttatcctgaatcgtggcggtgatgagaaccccagagggcctgtttctagggaacacgtggagtggtgtcgggagtttgtcaaaggaaagtacattatggccttcaatccaccctggggcgacatcaacaaaagcggccgctccgggattgctttggtggccaccggactcgcaaagctggctgaaacagagggtaagggcgtgtttgatgaagccaaaaagaccgtcgaggcgctgaacgggtatctcgacaaacatagagacgaagttgataaggcctcagcagacagtatgatcactaatttacctaaacacatagctaaggcccaagagctgtacaagaacagctctgctcttagggcccagggagcacagattgatacaccattctcctcattttactggttgtataaagccggcgtgacccccgagacgttccctactatcagccagttcctgtttgaactaggtgagcaaccacgggggaccaagaaaatgaagaaagctctcctgagtacaccgatgaagtggggaaagaaactttacgaactgttcgcggacgattcttttcagcagaatcgcatttatatgcatcccgcagtattgactgccggccgaatctccgagatgggcgtgtgcttcgggaccatccctgtcgctaacccagacgatgccgcacagggaagcggtcacacaaagtcgattctcaatctgagaacctctacggaaactaacaatccctgtgccaaaacaatagtgaagttatttgagatccaagagaccggcttcaacattcaggacatggatatcgttgcttccgaacatctgctccaccagtcaatagtggggaaacaaagtccttttcagaatgcctacaacgtcaagggaaatgcaactagcgcgaacattatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17042 - RNA, 5437 nt, synthetic construct
  misc_feature 1..5437: note = mRNA product Design2 comprising derived and/or modified sequence from CCHFV(10200)__U39455.2__GP (opt3)
  source 1..5437: mol_type = other RNA
ggggcgctgcctacggaggtggcagccatctccttctcggcatcaagcttaccatgcacatcagcctgatgtacgccattctctgccttcagctgtgtggcttgggggagacccatggatcccacaacgaaacaagacataataagactgacacgatgaccacacacggtgataacccctcttcagagcctccagtgagtactgctttaagcataaccctggacccgtccacagtcacccccactactcctgcatctggcctagaagggtcgggagaggtttatacctcaccacccatcacgactggcagcctccctctgagtgaaaccacaccagagcttcccgtgactaccggtacagataccctgtccgccggggacgtagatccttctacgcagactgcgggaggcacaagcgctccaaccgtgaggacttccttgcccaattcacccagtacacctagcaccccacaggacacgcatcaccccgtccggaacctcctgtctgtgacctcccctggcccagatgagacatcaactcccagcgggaccggaaaagaaagttctgccacatccagcccgcaccctgtttcgaatcgcccgccaactcctcccgcaaccgcccagggtccaacagagaacgactctcataatgctaccgaacaccccgagtccctgactcagtcagcaacgcctggcctcatgacaagtccaacccaaattgtgcatccgcagagcgccactcccatcaccgtccaggatacacacccttccccaaccaaccgatctaagcgtaatttaaaaatggagattatcctgactcttagccaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacccggcaccctgtcaacaactgagagtacccctgctggcctcccaacggccgaacccttcaagtcctactttgcgaaagggttccttagcatcgactctggatattactcagcaaagtgctatagtggtaccagcaactccggcctgcagttgattaatatcacaagacattctactaggatagtagacaccccggggcctaaaattacaaacctaaagactatcaattgtattaacctgaaggcctcgatctttaaagagcaccgggaagttgagatcaacgtgctcctgccacaagtcgctgtgaatcttagcaactgccatgtggtcattaagtcccacgtttgtgattactcactggacatagatggagccgtgcgcttgccccatatctaccacgagggcgtattcattcctggtacctataaaatcgtgatagacaagaaaaataagctcaacgatcgatgcacgctgtttacagactgtgtcattaaagggagagaagtgaggaagggccagagtgttttacggcagtacaagaccgagatccgtatcggaaaagcatctactggcttccgcagactgctaagcgaggaaccctccgatgactgcgtgtcaaggacacaactcctgcggaccgaaactgctgagattcacggggataattatggaggtccaggcgacaagatcaccatttgtaacgggagcacaatagtcgatcagcgacttggatctgagttgggctgctacacgatcaatcgcgtgagatcctttaaactgtgcgaaaacagtgccaccggtaagaattgtgagattgacagcgtacctgttaaatgcaggcaggggtattgtctccggatcactcaggaaggccgcggacatgtgaagctgtctagaggctccgaggtcgtgcttgacgcgtgcgatacatcatgtgagatcatgattcccaaggggaccggagacatactggtcgattgcagtggtggccaacagcacttcttgaaagacaacctcatcgatctggggtgtccaaagattccgttactgggaaaaatggccatctacatttgcaggatgagcaatcatcctaagacaactatggcattcctattttggttctcgtttggctatgtgatcacctgtatactctgcaaagctatcttctacctgcttattatcgttggtacgttggggcgtcggctgaagcagtaccgagaactcaagccccagacatgtaccatttgcgagactaccccagtgaacgccatcgacgctgaaatgcacgatctgaattgctcctataacatatgtccctactgcgcctctagattaacaagcgacggcctggcaaggcacgtaattcaatgtcctaaacgcaaggagaaagtcgaagagactgagctttatttgaatctcgaacggatcccatgggtggttagaaagctgctacaggtgtcagagagtaccggagtcgccctgaaaaggtcctcttggctcattgtgctgcttgtattgtttacagtgagcctgtcccccgttcagtcagctcctatcggccaggggaagacgatagaagcgtaccgcgcacgagagggatataccagcatctgcttattcgtcctcggcagtattctgtttatcgtgtcttgtcttatgaagggtctggtggattccgtcgggaacagcttctttccgggattgtcgatttgcaaaacttgttcaatctctagtataaacggcttcgaaattgagtcccataagtgctactgtagcctcttttgctgtccatattgccggcactgctctacagacaaagagatccataagctgcacctaagcatctgtaaaaagcgtaaaaccggttccaatgttatgctggccgtgtgcaagctcatgtgtttcagagctactatggaagtgtcaaacagggccctgtttattcgcagtatcattaatacaaccttcgtactttgcatattgatcctggcagtctgtgtggttagcacgtctgccgtggagatggaaaacttacccgctggcacttgggagcgggaagaggatctcaccaatttctgccatcaagagtgtcaggtcacagaaaccgagtgcctgtgtccttacgaagcccttgtgctgagaaagccactatttctcgactccactgcaaaagggatgaagaacctgctcaattcaacaagtctggagaccagcttatccattgaggcgccctggggagctatcaacgttcagtctacatacaaacctactgtgtcgaccgccaatattgcactcagctggtcatccgtagaacacaggggcaacaagatcctggtcagtgggcgatctgagagcataatgaaacttgaggaacgcacgggaatctcctgggatctgggcgtggaagacgcctcagagtctaagttgctcacagtgagcgtcatggacctgagtcagatgtattccccggttttcgagtacctaagcggtgatcggcaagtggaagagtggcccaaggctacctgcactggggactgtccagaaagatgcggatgcacctcttcaacatgtctgcacaaagagtggcctcattccaggaattggcgttgcaaccccacttggtgttggggcgtaggtaccggctgcacgtgttgcgggcttgatgtgaaggacctctttacagattatatgttcgtcaaatggaaggtggaatacattaaaaccgaggccatcgtttgtgtggagctgacaagtcaggaacgccagtgcagcttgattgaggcaggaacacggtttaatctgggcccagtcaccatcactttatcggaacctagaaacatacaacagaagttgcccccagagattatcacactgcacccgaggatcgaagaggggttctttgaccttatgcatgtgcagaaggttctgtctgcttccaccgtgtgtaaattgcagagctgcacgcacggagtccctggcgatctccaagtatatcatattggtaatctgctaaagggggacaaagtgaacggacacctgatacacaagatcgagccccatttcaacacttcatggatgagttgggatggctgtgaccttgattactattgcaatatgggtgactggccatcttgcacctacacaggcgttacccagcacaaccatgcctcctttgtgaatctcctgaacattgaaacagattacactaaaaatttccactttcacagcaagcgagtcaccgcgcatggggacacgccccagttggacttaaaggcccggcctacatatggagctggcgagatcactgtgctggtagaagtggcagatatggagctccacaccaaaaagattgagatctcagggctgaaattcgccagtcttgcttgtacaggatgctacgcctgtagctcctctataagctgcaaggtccgcatccatgttgacgaaccagatgagctgaccgtgcacgtgaaatccgacgatcccgacgtcgtggcagcgtcatctagtttgatggccagaaagctagaatttggcactgattcgaccttcaaggctttcagcgccatgcctaaaacatccctgtgtttttatattgttgagagggaacattgcaagtcttgttcagaggaggacacgaaaaagtgcgtaaacactaaactcgaacagccgcaaagcatcctgattgagcacaagggtaccatcatagggaaacaaaattccacatgtaccgcaaaggctagttgctggcttgaatctgtcaagagcttcttttacggactgaaaaacatgttatcaggcattttcggcaatgtgtttatggggatcttcctctttttggccccattcatcctgctcattctgtttttcatgtttggatggcggatccttttctgtttcaagtgctgccgaagaactcgcggtctgtttaaatataggcacttgaaggatgacgaggaaacaggctaccgtcggataattgagaaactaaacaataagaaggggaaaaacaagctgctcgatggagagagattagcagacggcaggatcgccgaactgttctccaccaaaacgcatattggttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17043 - RNA, 5437 nt, synthetic construct
  misc_feature 1..5437: note = mRNA product Design2 comprising derived and/or modified sequence from CCHFV(IbAr10200)__AF467768.2__GP (opt3)
  source 1..5437: mol_type = other RNA
ggggcgctgcctacggaggtggcagccatctccttctcggcatcaagcttaccatgcacatcagcctgatgtacgccattctctgccttcagctgtgtggcttgggggagacccatggatcccacaacgaaacaagacataataagactgacacgatgaccacacccggtgataacccttcttcagagccaccggtgagtactgctttaagcataaccctggacccctccacagtcacccctactacaccagcatctggcctagaagggtcgggagaggtttatacctcaccccctatcacgactggcagcctcccactgagtgaaaccacacccgagcttcctgtgactaccggtacagataccctgtccgccggggacgtagatccatctacgcagactgcgggaggcacaagcgctccgaccgtgaggacttccttgcccaattcacctagtacaccaagcacaccccaggacacgcaccatcctgtccggaacctcctgtctgtgacctccccaggccccgatgagacatcaactccgagcgggaccggaaaagaaagttctgccacatccagccctcaccccgtttcgaatcgcccacctactcccccagcaaccgcccagggtcccacagagaacgactctcacaatgctaccgaacatcctgagtccctgactcagtcagcaacgccaggcctcatgacaagtccgacccaaattgtgcacccccagagcgccactcctatcaccgtccaggatacacatccatcccccaccaaccgatctaagcgtaatttaaaaatggagattatcctgactcttagccaggggttgaagaaatactatggaaagatactgagactactccaactgacacttgaagaggacacggaaggcctgttggagtggtgcaagaggaacctcggtctggattgtgacgataccttctttcagaaacggatcgaagagttctttattactggggagggacacttcaatgaagtgttacagtttcgcacacctggcaccctgtcaacaactgagagtaccccagctggcctccccacggccgaaccgttcaagtcctactttgcgaaagggttccttagcatcgactctggatattactcagcaaagtgctatagtggtaccagcaactccggcctgcagttgattaatatcacaagacactctactaggatagtagacacccctgggccaaaaattacaaacctaaagactatcaattgtattaacctgaaggcctcgatctttaaagagcatcgggaagttgagatcaacgtgctcctgccccaagtcgctgtgaatcttagcaactgccacgtggtcattaagtcccatgtttgtgattactcactggacatagatggagccgtgcgcttgcctcacatctaccatgagggcgtattcattcccggtacctataaaatcgtgatagacaagaaaaataagctcaacgatcgatgcacgctgtttacagactgtgtcattaaagggagagaagtgaggaagggccagagtgttttacggcagtacaagaccgagatccgtatcggaaaagcatctactggcagccgcagactgctatccgaggaaccatcagatgactgcattagcaggacacaactcctgcggaccgaaactgctgagatccacggggataattatggaggtcctggcgacaagattaccatatgtaacgggtctacaatcgtggatcagcgacttggatccgagttgggctgctacacgattaatcgcgtcagaagtttcaaactgtgcgaaaacagcgccaccggtaagaattgtgagatcgactctgtgcccgtaaaatgcaggcaggggtattgtctccggatcactcaggaaggccgcggacacgttaagctgtccagaggctcagaggtggtccttgacgcgtgcgatacaagttgtgagattatgataccaaaggggaccggagacatcctggtggattgcagcggtggccaacagcattttcttaaagacaacctcattgatctggggtgtccgaagatccctttactgggaaaaatggccatttacatctgcaggatgtcgaatcaccccaagacaactatggcattcctattctggttttccttcggctatgtcataacctgtatcctctgcaaagctatcttttacctgcttattattgtgggtacgttggggaagcgtctgaagcagtaccgggaactcaaaccacagacatgtaccatctgcgagactacccccgttaacgccatagacgctgaaatgcatgatctgaattgctcttataacatttgtccttactgcgccagccgattaacatcagacggcctggcaagacacgtgatccaatgtccaaagaggaaagagaaggtagaagagactgagctttatttgaatctcgaacgcattccctgggtcgtgcggaaactgctacaggttagtgagtccaccggagtggccctgaagagatctagctggctcatcgtcctgcttgtgttgttcacagtatccctgtcacctgtgcagagcgctccgataggccaggggaagacgatcgaagcgtacagggcacgcgagggatataccagtatttgcttatttgttctcggctctatcctgttcattgtctcctgtcttatgaaaggtctggtggatagcgtggggaactcgtttttcccaggattgtcaatctgcaagacttgttctataagttccattaacggctttgaaatcgagagccacaaatgctactgttctctcttctgctgtccctattgccgacattgcagcacagacaaggagatccacaaactgcatctatccatttgtaagaaacggaagaagggttcaaatgtcatgctggccgtttgcaaactcatgtgttttcgtgctaccatggaagtgagtaacagagccctgttcatcaggagcattataaatactacatttgtgctttgcatcttgattctggcagtatgtgtcgtgtctacctccgccgttgagatggaaaacttacctgctggcacgtgggagcgcgaagaggatctcactaatttctgccaccaagagtgtcaggtgaccgaaacagagtgcctgtgtccatacgaagcccttgtcctgcggaagcccctattcctcgactcaaccgcaaaagggatgaagaacctgttgaatagtactagcctggagacatccttatctatcgaggcgccttggggagctattaacgtgcagtcgacctacaaaccgacagttagcactgccaatatcgcactctcatggtccagtgtggaacatagaggcaacaagatactggtatctgggaggagcgagtccatcatgaaacttgaggaacgaaccggaatttcatgggatctgggcgtcgaagacgcctctgagagcaaattgctcacggtgagtgtgatggacctgtcccagatgtatagccccgtctttgagtacctatctggtgatcgccaagttggggaatggccaaaggctacatgcaccggagactgtcctgagcggtgcggctgcacttcatccacctgtctgcacaaagaatggccccacagtagaaattggaggtgcaacccaacatggtgttggggtgtgggcactgggtgcacctgttgcggacttgatgtaaaggacctcttcacggattatatgtttgtgaaatggaaggtcgagtacatcaagacagaagccattgtgtgtgttgagctgaccagccaggagcgtcagtgctcgttgatcgaagcaggcactcgcttcaatctggggcctgtgacaataaccttatctgagccccggaacattcaacagaaactcccaccggaaatcatcactctgcatcctagaattgaggaaggatttttcgaccttatgcacgtccagaaggtgctgtccgctagcacagtttgtaaattgcagtcatgcacccatggcgtgcccggtgatctccaagtctatcacatagggaatctgctaaagggagacaaagtaaacggccatctgatccacaagattgagccacactttaacacgagttggatgtcttgggatggttgtgaccttgattactattgcaatatgggcgactggccctcctgcacttacaccggggtgacacagcataaccacgccagcttcgttaatctcctgaacatcgagaccgattacacaaagaattttcatttccactcaaaaagggtgactgcgcacggagacacccctcagttggacttaaaggcccgaccaacgtatggcgctggggaaattacagtcctggtggaggtagcagatatggaactccatactaaaaagatcgagataagtggactgaaatttgccagccttgcttgtaccggctgctacgcctgttcctctggtatcagctgcaaggtgcggattcacgtcgacgagcccgatgaactgacagttcatgtgaaatccgacgatcctgacgtggtcgcagcgtcatctagtttgatggcccgcaagctagagttcgggaccgattcgacttttaaggctttcagcgccatgccgaaaacctccctgtgtttctatatcgtggaaagagagcactgcaagtcttgttcagaagaggacaccaaaaagtgcgttaacacgaaactcgagcagccacaaagcattctgatcgaacataagggaactataattggcaagcaaaattccacctgtacagcaaaagctagttgctggcttgagtctgtaaagagctttttctacggcttaaagaacatgctgtcagggatctttggaaatgtgttcatgggtatctttctcttcttggccccctttattctgctcatcctgttctttatgttcggctggaggatattgttttgtttcaagtgctgccggcgaaccagagggctgttcaaatatcgccacttgaaggatgacgaagagactggatacaggcgtattatcgaaaagctaaacaataaaaagggcaaaaacaagctgctcgatggtgagcggttagcagacagaaggattgccgagctgttttccacaaaaacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17044 - RNA, 5449 nt, synthetic construct
  misc_feature 1..5449: note = mRNA product Design2 comprising derived and/or modified sequence from CCHFV(Turkey-Kelkit06)__GQ337054.1__GP (opt3)
  source 1..5449: mol_type = other RNA
ggggcgctgcctacggaggtggcagccatctccttctcggcatcaagcttaccatgcccaccaacatcatgcacacacctctggtgtgcttcattctctaccttcagctgttgtgtttaggcggggcccatggacaactgaatgctactgagcacaacggtacgaataacaccacagcaccaggcgccagccagtccccgaagccccctatgtctactaccccaccccatgcgcctgaatcaagtacaataaaaccaaccactcccatcagcgaggctgaagggtccggagagacaacctctcctccaaatacgactcagggcctatcgtcaccggaaaccacaagcgagagacccgccactaccagtatttccacatctagcaccgactccacgaaccctactacacagatgaccgataatactccaacacccaccgtctcaacgagtccttcttcttccccatcaacccccagcacaccgcaaggtatccaccatcctgcaaggagtctcctgtctgtttccagccccaagactgtgaccacaccaactcctacctcgcccggggagatgtcttccgaaacatcaagtcagcacagcgccatgtcccggattccaactccccacactgctacgcgcgtatctacagagatcaccaaccatcgaactcctcgtcagagcgaatcaagtgcacagcaaaccacaccatccccgatgaccagccccgcccagtctatacttctgatgtcagctgcccctactgcggtgcaggacatccacccaagtcccacaaatagaagcaaaaggaacttggagacggagattatcctcaccctgtcccagggactgaagaaatattacggcaagattctcaagttactgcatcttactttggaacaagatacagagggcctgctagaatggtgcaaagggaatctcggatctaactgtgacgatgactttttccagaagcggatcgaggaatttttcatgaccggtgagtgctattttaatgaggtcctgcagttcaaaacactttcgactctgagccctaccgaaccatcccacgcacgcttgcccacggccgagccgtttaagtcatacttcgctaaaggctttctcagtatagattctgggtatttcagcgccaagtgttaccctagatcctcagcaagcggactgcaattaattaacgtgacccagcacccagctaggatcgccgaaacacccggccctaagactacctctctgaaaacaattaattgcatcaacctccgggcgtccgtttttaaggagcatcgcgaagtggagatcaacgtccttctgccccagattgccgtgaatttgagtaactgtcacgtagttataaatagccatgtgtgcgactattctctagatactgacggtccagtccgactgcctagaatctaccacgaggggaccttcattcccggaacgtacaaaatcgtgatagataagaaaaacaagctcaatgacaggtgtacactggtgaccaactgcgtcattaaaggccgggaagttcgtaagggccagtccgtgcttcgccaatataagactgagatcaaaatcgggaaggcatcaacaggatttagaaaactgttgagtgaggaaccaggtgatgactgtattagcaggacccagctcctgcggactgaaaccgctgagatccatgacgataattacggcgggccgggagacaagattacaatatgcaacggctcgacgatcgtagatcagcgattaggttccgagctggggtgctataccattaatcgcgtgaaatctttcaagctatgtaagaacagcgccactggcaaaacatgcgaagtcgactcaacccctgtgaagtgtagacagggattctgcctcaaaatcacacaagagggcagggggcacgttaagctgagtcggggatccgaagtggtccttgatgcttgtgactctagctgcgaggtgatgatccccaaaggtactggcgatattttggtagactgttccgggggacagcagcactttctgaaggataatctcatagacctgggctgcccacatatcccccttctgggtcgcatggccatttacatctgtagaatgtcaaaccaccctaggaccacgatggcattcttgttttggttcagctttgggtatgttattacatgcatcttctgtaaggccctcttttacagtctgataatcattggcaccttagggaaaaagatcaaacagtatcgtgagctgaagccacaaacttgcaccatttgcgaaacagctcccgtgaatgcgatcgatgcagagatgcatgacctaaactgttcttacaatatatgcccttactgtgcctcccggctcactagcgacggcctggctcgacacgtcacccagtgcccgaaaagaaaggaaaaggtggaggaaacagagctttatttgaacctggagaggattccatggatcgtccgcaaactcctgcaagtgtcggaatcaacgggggttgccttaaagcggtctagttggctgattgtgcttttggtactcctgaccgtctccctaagccccgtgcagtctgcacctgttggacacggtaaaactatcgagatataccagacaagagaaggcttcgccagcatctgtctgtttatgctcgggtccattctgttcatcgtgtcatgccttgtcaagggattggtggatagtgtaagcgagagctttttcccaggcctgtccgtgtgtaaaacctgctcaattggtagtgttaacgggtttgaaatcgagagccataagtgttattgctccttattctgttgcccctactgcaggcactgttctgctgaccgcgagatacatcagctccacctgtcgatttgcaaaaagcgaaagactggcagcaatgtcatgcttgccgtgtgtaaacggatgtgcttccgtgcaacaatcgaagcgtcaagaagggctctgttgatccgctccattatcaacaccacgtttgtgatttgtatactcactctgaccatctgcgtcgttagtacatctgccgtggagatggaaaatctacctgcaggaacctgggagcgggaagaggatctgactaacttctgtcatcaggagtgccaagtgacagaaaccgagtgtctctgcccgtatgaagccctggtacttagaaagcccttgtttctggacagcattgtcaaaggcatgaagaatttactcaactccacatcactggagacttctcttagcatcgaggctccatggggagccattaatgtgcagagtaccttcaaacctacggtttccacagcaaacatcgctctgagctggtcttcagtggtccacaggggaaataagatattggtgaccggccgatccgaaagtatcatgaagctcgaggaacgcactggtgttagctgggatctgggggtggaggacgcctcggaatctaaattgctgaccgtatccattatggatttaagccagatgtactcacccgtctttgagtatctcagtggagacagacaggtggaggaatggccaaaggcgacatgtactggcgattgccctgagcggtgcggttgtacctcttccacgtgcctgcacaaagaatggagccattcaaggaactggcgttgtaatcccacatggtgctggggcgtggggaccggatgtacttgctgtggcgtcgacgttaaggatcttttcacagaccacatgtttgtgaaatggaaggtagagtacatcaagaccgaagccattgtgtgcgtcgctctgaccagtcaagagcgccagtgtagcttgatcgaggcagggacacggttcaacctcggaccagtgaccataacgctgtccgaaccgagaaatattcagcagaaactacctcccgagatcatcactctgcatccaaagattgaagagggctttttcgatcttatgcacgttcaaaaagtgctctctgccagcaccgtctgcaagctgcagtcctgtacacatggtatacccggggacctacaggtgtaccacatcggaaacctgttaaaaggcgacagggttaatggtcacctcattcataagatcgaatcacactttaacacctcttggatgagttgggatggctgcgacctggattattactgcaacatgggggactggccttcgtgtacatatactggagtgacccagcataatcacgctgccttcgtcaaccttctgaatattgagacggattacacaaagacttttcacttccatagcaaacgagtaaccgcacacggcgacacaccacaattggatctcaaggcgcggcccacctatggggccggaggcatcactgtgctggttgaggtggctgacatggaactacataccaaaaaggtcgagatatccggtctgaaattcgcctctcttgcatgcacagggtgttacgcttgctcaagcggaatctcctgtaaggtgcgcattcacgtagatgaacctgacgagctcacggtgcatgtcaaaagttctgatccggacgttgtggccgcaagcacttcactgatggccagaaagttggagtttggcaccgattccacattcaaggcttttagtgcgatgccaaaaaccagcttatgcttctatatcgtggaaagggagtactgtaagtcttgctccgaagacgacactcagaaatgtgtcgatacacggctggagcagccccaatcaattctcatcgaacacaagggtaccataattggcaaacagaacgacacgtgcactgccaaggcaagctgttggctggagtcggtgaagtctttcttttacgggcttaaaaatatgctgggaagtgtttttggcaacttgttcatcgggatcctactgtttctcgctcctttcgtactgcttgtgttatttttcatgttcggatggaagattctgttttgcttcaaatgctgtcgaagaacacgcggcctctttaagtataggcacttgaaagatgacgaggaaaccggttaccgtcggatcatagagagactgaactccaagaaggggaaaaataggctcctggatggagaccgccttgccgatcgaaagattgccgaactgttcagcaccaaaactcatatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17045 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (opt3)
  source 1..3961: mol_type = other RNA
ggggcgctgcctacggaggtggcagccatctccttctcggcatcaagcttaccatgcacatcagcctgatgtacgccattctctgccttcagctgtgtggcttgggggagacccatggatcccacaacgaaacatctgaggaaccctcagacgattgcgtgagtagaactcaattactgaggacggagaccgctgaaatacatggtgacaattatggcgggcctggagataagatcacaatttgtaacggcagcactatcgtcgaccagcggctaggttccgagctcgggtgctacaccattaatcgcgttcgatctttcaaactgtgtgagaactcggcaacaggaaagaattgcgaaatcgattcagtgccagtaaaatgtcgtcagggctattgccttagaataacccaggagggcagggggcacgtgaagctgagccggggaagtgaagtcgtgttggacgcctgtgatacttcctgcgagatcatgattccgaaaggtacaggcgacatcctcgttgattgttctgggggacaacagcattttctgaaggacaacctgattgatctcggctgccccaagatccctttactgggtaaaatggcgatatacatttgccgcatgagcaatcacccaaagaccacgatggctttcttgttttggttctcctttgggtatgtgatcacttgtattctttgcaaagccatcttctacctgctaatcattgtcggaaccctcggcagaaggctgaagcagtatcgggagcttaaaccccagacatgtactatatgcgaaaccacacctgtgaacgcaatcgacgccgagatgcacgatctgaattgttcatacaacatttgcccatactgtgctagtcgcttgaccagcgacggcctcgcacgacatgtaatccaatgccccaagagaaaggaaaaagttgaggaaacggagctgtatttaaatctggagaggataccttgggtggtccggaagctccttcaggtgtctgaatccactggggtggccctgaaacgttcaagctggttgattgtcctactggttctctttacagtgagtctgtctccagtacagtccgctccgatcggacagggtaagaccatcgaggcctaccgcgcgagagaaggctatactagcatttgtcttttcgtgctggggtcgatcttgtttattgtctcttgcctcatgaaaggactggtggactccgttggcaactcattctttcccggtttaagtatatgtaagacatgcagcatctcctctattaatgggttcgagatcgaaagccacaaatgctactgttcactgttttgctgtccttattgcaggcattgtagtaccgataaggagatccacaagctacacctctccatttgcaaaaagcggaaaacgggcagcaacgtgatgctggcagtctgtaaacttatgtgcttccgagccaccatggaggtgtctaatcgcgctttgttcataagatcaatcattaacacaacttttgtactgtgtatcctcattctggccgtttgcgtggtcagtaccagcgcagtggaaatggagaaccttccagctggaacatgggaaagggaggaagacctgactaatttctgtcatcaagagtgccaggtcaccgagacagaatgcttgtgtccctacgaggccctcgtgctgcggaaacctttatttctggattccaccgcgaagggcatgaagaacctactcaattctacttcgctggaaacgagcctttccatcgaggccccatggggagcaataaacgttcagtcaacatataaacccaccgtgagtactgctaatatcgccttgtcttggagctccgtagagcaccgcgggaacaagattctggtctcaggtagaagcgaatctatcatgaaactcgaggaaaggaccggcatttcctgggacctgggggtggaggatgctagtgaaagcaagttactgacagtttctgtgatggacctttcccaaatgtactcaccggtcttcgagtacttgagtggagatcgtcaggtggaggaatggcctaaagcaacctgcactggcgactgtcccgagcggtgcggttgtacaagctcgacgtgcctccataaggaatggccacactcccgaaattggagatgtaaccctacctggtgctggggcgtagggactggatgtacatgctgtggcctggatgtgaaggacctatttaccgattatatgttcgttaaatggaaggtcgagtacatcaaaacagaagccatagtgtgcgtggagctgacttctcaggagaggcagtgcagcctcattgaagccgggacccgctttaatctgggacccgtcacgatcaccctttcagagccacggaacattcaacagaagttgccccctgaaatcataacactgcatccaagaatcgaggaaggtttctttgacttaatgcacgttcagaaagtgctcagtgcttccactgtgtgtaagctgcagtcttgcacccacggcgtaccgggggaccttcaagtctatcatattggaaatctgttgaagggcgataaagtgaacggtcacctcatccataagattgagccccacttcaatacaagctggatgtcctgggacgggtgtgatctggactactattgcaacatgggcgattggccttcatgtacttacaccggagttacgcagcacaatcatgcgagctttgtgaacctactgaacatcgagacagactataccaaaaatttccactttcatagtaagagggtcactgcacacggcgatacaccacagctcgacctgaaagcccgccccacctacggggctggagaaataactgtgcttgttgaggtggccgatatggaattgcataccaagaaaattgagatctctggcctgaagttcgcatccttagcctgcacaggttgttacgcttgcagctcgtcaatctcttgtaaggtacggattcacgtcgacgagcctgatgaactcacggtgcacgtgaaaagtgacgatccagacgtcgttgccgcatccagctctctgatggcgcgaaaacttgagttcgggaccgacagcacttttaaggctttctccgccatgcccaagacatcactgtgcttttatatcgtggaacgtgagcattgtaagagttgcagcgaagaggataccaagaagtgcgtaaacacaaaactagagcagccgcaatctattctcatagaacacaagggaactatcattggcaaacagaatagcacctgtacggcaaaggcctcatgctggctggagagtgtgaaatccttcttttacggtttgaagaacatgctgtccggcatcttcgggaatgtctttatgggaattttcttatttctcgctcctttcatcctgcttatactgtttttcatgtttggctggagaatcttgttctgtttcaagtgctgtaggcgcacacgggggctctttaaatatagacatctgaaggacgatgaagagaccggatacaggcgaattatcgaaaaactaaacaataagaaaggcaagaacaagctgcttgacggtgagcgcctcgccgatgggcggattgcagagctgttctctactaaaacccacatcggatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17046 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (opt3)
  source 1..3934: mol_type = other RNA
ggggcgctgcctacggaggtggcagccatctccttctcggcatcaagcttaccatggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacaccagttgcgagataatgatcccgaaaggcacaggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggccagggcaagaccatcgaggcatatagagccagggaagggtacacttccatctgtctgtttgtgctcggaagcattctgttcatcgtttcgtgccttatgaaaggtctggtggattctgtcggcaattcctttttccccgggttgtcaatttgtaagacatgcagtataagctccatcaacggatttgagattgaatctcacaaatgttattgcagcctcttctgctgtccttactgccggcattgttcaaccgacaaggagatccacaagctgcatttaagtatctgcaaaaagcgaaaaacgggctccaatgtgatgctggctgtatgtaagctaatgtgcttccgcgccaccatggaagttagcaacagagcactctttattaggtctataatcaatacaactttcgtgctgtgtattcttatcttggctgtctgcgtggtctcaaccagtgccgtggagatggagaacctgccagcgggtacatgggaacgggaggaagatctcactaacttttgtcaccaggagtgccaagttaccgaaacagagtgtctgtgcccctatgaggcccttgtgctgcgcaaacctttgttcctcgacagcaccgcaaaggggatgaagaatctgttaaactccacttctctggaaacgtcgctaagcattgaggctccatggggcgccatcaatgtacagtccacatacaaacccaccgtctcaactgctaacatagccctcagttggtctagcgtggaacacagaggaaataagatcctggtttccggcaggtcagagagcattatgaaacttgaggaacgtaccgggatctcttgggatttgggagtggaggacgcatccgaaagtaagctgctcacagtcagcgtgatggatctgtctcagatgtattccccggtatttgagtacttatcaggtgaccggcaagtggaagagtggcctaaagccacttgcactggcgattgtcccgagcgatgcgggtgtacaagtagcacgtgcctgcataaggaatggccacactcgagaaactggaggtgtaatcctacctggtgctggggagttggcactggttgtacatgctgtgggcttgacgtcaaggatttgttcaccgactacatgtttgtgaaatggaaggtggagtatattaaaacagaagctatcgtctgcgttgagctcacttcccaggaacgccagtgttctctgatagaggcgggcacccggttcaacctaggacccgtgacgattaccctgagcgagccaagaaatatccagcaaaagctgccccctgaaattatcacactccatccaaggatagaggaaggctttttcgaccttatgcacgtgcagaaagtattgtcagcaagtactgtctgcaagctgcagtcctgcacccatggggtgccgggagatttacaggtttaccacatcggtaacctcctgaagggcgacaaagtgaatgggcaccttattcataagatcgagccccactttaacacatcttggatgagctgggatggatgtgacctggattattactgcaatatgggcgactggccttcctgtacttataccggtgtcacgcaacataaccacgcctcattcgtgaatttgctcaacattgaaacagattacaccaaaaactttcacttccatagcaagcgcgttactgctcacggggacacaccacagctggatctaaaagcccgacccacctatggcgcaggagagatcactgtgctggtagaggtcgccgacatggaactccataccaagaaaatagagattagtggcctgaagttcgcttctcttgcctgcacagggtgttacgcatgctccagctcgatctcatgtaaggtgcggatccacgtggatgaacctgacgagttgacggtccatgttaaatctgatgacccagacgtggtagcggctagttccagcctgatggcccgtaagttagagtttggaaccgattctactttcaaagcatttagcgccatgcccaagacatccctctgcttctacattgtggaaagagagcactgtaaatcatgcagtgaagaggacaccaagaagtgtgtcaatacaaaactggaacagccgcagagcatccttattgagcacaagggcactataatcggtaaacaaaactctacctgcacggctaaggcctcctgctggctggagtcagtgaaaagtttcttttatgggctaaagaatatgctcagcggaatttttggcaacgttttcatgggtatctttctgttcttggcaccttttattctgttaatcctcttctttatgttcggctggaggatactgttctgttttaagtgctgtcgccggacaagagggcttttcaaatacaggcatctgaaggatgacgaagagaccggatatcgacgcatcattgaaaaattgaataacaagaaaggcaagaataagctcctggatggggagcggctagctgacggaagaatcgccgaactgttttccactaaaacccacattggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17047 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (opt3)
  source 1..3355: mol_type = other RNA
ggggcgctgcctacggaggtggcagccatctccttctcggcatcaagcttaccatggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacacaagttgcgagataatgatcccgaaaggcacaggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggcagaaagcccctgtttctcgattccaccgcaaaaggcatgaagaatctgcttaacagcacttcgctggagacatctttgtccatcgaagccccttggggagctatcaatgtgcagtcaacctataaaccaacggttagtaccgccaacattgcactcagctggtcctctgtggagcacagggggaataagatcctggtcagcggtcggtcagaaagtattatgaagttagaggaacgaacaggcatatcctgggacctgggggtggaggatgctagcgagtctaaactactcactgtatcagttatggacctgagtcagatgtacagccccgtgttcgaatatctttccggagatcgccaagtcgaggaatggcctaaggccacctgtacaggcgactgcccagagagatgtggttgcacttcttcgacctgtttgcataaagaatggccccacagcaggaactggcggtgcaacccgacatggtgctggggcgtggggaccggatgtacttgctgtggcctggatgtcaaggacctctttacggattacatgttcgtgaaatggaaggttgagtatatcaagacagaggcgattgtgtgcgtagaactgacctcccaggagcgccagtgttcacttatcgaagccgggactagatttaatctgggacctgtcaccatcacattgagtgagcccaggaacattcaacagaaactcccacctgagataatcaccctgcatccccgtattgaagagggtttcttcgacttaatgcacgtgcagaaggttctgtctgcaagcactgtgtgcaaactacagtcctgtacacacggcgtcccaggggatctccaagtgtaccatatcggaaatctgcttaagggcgacaaagtaaacggtcacttgattcataagatcgaaccccactttaatacgtcatggatgagctgggacgggtgcgatctggactattactgtaacatgggcgattggccttcttgcacctacactggagtgacacagcataatcacgcttccttcgttaacctcctgaatatagagaccgactatacaaagaactttcacttccatagtaaacgggtcactgcccacggcgataccccacagttagacctgaaggctcgaccgacgtacggggccggagaaatcaccgtgcttgtggaggtcgcagatatggagttgcatactaaaaagattgaaatcagcggtctcaaatttgcctctctggcttgtactggctgctatgcgtgctcctcaagtattagctgtaaggttagaatccacgtggacgagcccgatgaactaaccgtgcacgtaaagtcggacgatcctgacgtcgtggcagcctcctctagcctgatggctaggaaactcgagttcgggacagattcaacttttaaggccttcagtgcaatgccaaaaacctccctgtgcttttacatagttgaacgcgagcattgtaagtcttgcagcgaggaagacacgaaaaagtgtgtgaatacaaaacttgagcagccccaatccattttgatcgaacacaagggaaccattatcggcaagcagaactcaacttgcacagccaaagctagctgttggctggagagtgtcaagtctttcttttatggtctcaaaaatatgttatccgggatattcggcaacgtgtttatgggaatcttcctgttccttgccccttttattctgttgatcctcttctttatgttcggctggcggattctgttttgcttcaagtgttgcagaaggacccgcgggctatttaaataccgacatctgaaggacgatgaagagactggatatcggcgtatcatagagaagctcaataacaaaaagggcaaaaacaagctgcttgacggtgaaagattggcagatgggaggattgcggagctgttcagcaccaaaacacacatcggatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17048 - RNA, 1411 nt, synthetic construct
  misc_feature 1..1411: note = mRNA product Design2 comprising derived and/or modified sequence from CCHVF(10200)__U39455.2__IgE-leader_Gn (opt3)
  source 1..1411: mol_type = other RNA
ggggcgctgcctacggaggtggcagccatctccttctcggcatcaagcttaccatggactggacctggatcctgttcctcgtggccgctgcaacaagagtccacagctccgaggaaccctctgatgactgcgtttcaaggactcagcttctgcggacggagaccgccgaaattcatggcgataactacgggggacctggtgacaagataacaatctgtaatggcagtactattgtggatcaacgcttggggagcgagttaggatgctataccatcaaccgagtacgttcctttaaactgtgtgaaaattctgcgacaggcaagaactgcgagattgactcggtgccagtcaaatgtagacagggttactgcctaaggatcacccaggaggggcggggacacgtgaagctctcacgcggcagcgaagttgtgctggatgcttgtgacacaagttgcgagataatgatcccgaaaggcactggggatattcttgtcgactgttccggaggtcagcaacatttcctgaaggataatttgatcgacctcggctgccccaagattcctctgctggggaaaatggccatctatatatgtagaatgtctaaccacccaaagaccacgatggcatttctcttctggtttagcttcggatacgtgattacttgcatcttatgcaaagccatcttttatctgcttattatcgtaggcaccttgggtaggcggctgaagcagtaccgcgaactaaaaccccagacatgtactatttgcgagaccacacctgttaatgctatagatgcagagatgcatgacctcaactgttcctataatatctgcccatactgtgcctcacgactgaccagtgacgggcttgctagacacgtgattcagtgccccaagaggaaggaaaaagtcgaggaaacggagctgtacttgaacctcgaacggatcccttgggtggtgcgtaagctgttacaagtcagcgagtctactggagttgccctgaaacgctcctcatggctcatagtgcttctggtattgttcacagtgagcctaagtccagtccagtctgcgccgattggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17049 - RNA, 2371 nt, synthetic construct
  misc_feature 1..2371: note = mRNA product Design2 comprising derived and/or modified sequence from CCHVF(10200)__U39455.2__IgE-leader_Gc (opt3)
  source 1..2371: mol_type = other RNA
ggggcgctgcctacggaggtggcagccatctccttctcggcatcaagcttaccatggactggacctggatcctgttcctcgtggccgctgcaacaagagtccacagctttcttgattccactgccaagggcatgaaaaacctgttaaattctacgtcattggagaccagtctgagcattgaagcgccctggggagctataaacgttcagtccacatacaagcctactgtgtctaccgccaatatcgcactatcgtggtcaagcgtagagcatagggggaacaaaattctcgtgagtggtcggtccgaatctatcatgaagctggaggaacgcacaggcattagctgggaccttggggtcgaggatgcctccgagtcaaaactgttgaccgtgagtgttatggacctcagccagatgtattctccagtgttcgaatacctgtccggagatcgacaggtcgaggaatggccgaaggctacttgcacaggcgactgtcccgagcgttgcggttgtacctcaagcacgtgcctgcacaaggagtggcctcatagtagaaattggaggtgtaacccaacttggtgctggggagtggggaccggctgtacatgctgtggcctcgatgtaaaagacttatttactgattatatgttcgttaagtggaaagtggaatacatcaagaccgaggcaatagtctgcgtggaactgacatctcaggagcggcagtgttcccttatcgaagccgggacccgctttaatttgggacccgtgacgattactctgagcgagcctagaaacatccaacagaaactaccacccgagattatcacactccaccctaggatagaagagggtttctttgacctgatgcatgtccagaaggttctttcggcttctaccgtgtgcaagctgcagtcctgcactcacggcgtaccaggggatttgcaagtgtatcacattggaaatctcctgaaaggcgacaaggtcaacggtcatttaatccacaaaattgaaccgcatttcaatacatcatggatgagttgggatgggtgtgacctggactactattgcaacatgggagattggcccagctgtacctacacgggcgtgacccagcacaatcacgcctcctttgttaacctccttaatatcgagacagactacactaagaacttccattttcactctaaacgggtgaccgcgcatggcgatacacctcagctggacttgaaggcacgcccaacttatggggccggagaaatcaccgtcctagtggaggtagctgatatggagctgcacaccaaaaagattgaaataagcggtctcaagttcgcctcactggcatgcacaggctgttacgcttgcagttccagcatctcttgtaaagttcgaatccatgtggacgagcccgatgaacttactgtccacgtgaagtcagacgatcctgacgtcgtggccgcgagtagctccctgatggccagaaaattggagtttgggacggattctacattcaaggcattctcggctatgccaaaaaccagcctctgcttttatattgttgaaagggagcactgtaagtcctgctcagaggaagacactaagaaatgtgtgaacaccaagctggagcagccccaaagtatattaattgaacataaaggaacaatcatcggcaagcaaaattctacctgcactgccaaagctagctgctggctggagtccgtaaagtcattcttttacggtctaaagaacatgctcagcgggattttcggcaatgtctttatgggaatcttcctgtttcttgccccgttcattttgctgatactctttttcatgtttggctggcggatcctgttctgttttaaatgctgtcgtcgcacaagagggcttttcaagtataggcacctgaaagacgatgaggaaacgggataccggcgaattatcgagaagttgaacaataaaaagggtaagaacaaactcctggacggcgaacgcttagcagatgggagaatcgccgagctgttctctaccaagactcatattggatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17050 - RNA, 1831 nt, synthetic construct
  misc_feature 1..1831: note = mRNA product Design2 comprising derived and/or modified sequence from CCHFV(10200)__NC_005302.1/U88410.1__N (opt1) R6082
  source 1..1831: mol_type = other RNA
ggggcgctgcctacggaggtggcagccatctccttctcggcatcaagcttaccatggagaacaagatcgaggtgaacaacaaggacgagatgaaccgctggttcgaggagttcaagaagggcaacgggctggtcgacaccttcaccaacagctactccttctgcgagagcgtgcccaacctcgaccggttcgtgttccagatggcctccgccacggacgacgcgcagaaggacagcatctacgcctccgccctggtcgaggccaccaagttctgcgccccgatctacgagtgcgcgtgggtgagctccaccggcatcgtgaagaaggggctggagtggttcgagaagaacgccggcaccatcaagagctgggacgagtcctacacggagctcaaggtcgacgtgcccaagatcgagcagctgaccgggtaccagcaggccgccctgaagtggcgcaaggacatcggcttccgggtgaacgcgaacaccgccgccctcagcaacaaggtcctggccgagtacaaggtgcccggcgagatcgtgatgtccgtcaaggagatgctgagcgacatgatccgccggcgcaacctcatcctgaaccgcgggggcgacgagaacccccgggggccggtgtcccacgagcacgtggactggtgccgggagttcgtcaagggcaagtacatcatggccttcaacccgccctggggcgacatcaacaagagcgggcgctccggcatcgcgctggtggccaccgggctcgccaagctggccgagacggagggcaaggggatcttcgacgaggccaagaagaccgtggaggcgctgaacggctacctcgacaagcacaaggacgaggtcgaccgggccagcgccgactccatgatcaccaacctgctgaagcacatcgccaaggcccaggagctctacaagaacagctccgcgctgcgcgcccagagcgcccagatcgacaccgccttcagctcctactactggctgtacaaggccggcgtgacgcccgagaccttccccaccgtgagccagttcctcttcgagctggggaagcagccccggggcaccaagaagatgaagaaggcgctgctctccacgcccatgaagtgggggaagaagctgtacgagctgttcgccgacgacagcttccagcagaaccgcatctacatgcaccccgccgtcctcaccgccggccggatctccgagatgggggtgtgcttcggcaccatcccggtggcgaaccccgacgacgccgcccagggcagcgggcacaccaagtccatcctgaacctgcgcacgaacaccgagaccaacaacccctgcgccaagaccatcgtcaagctgttcgaggtgcagaagacgggcttcaacatccaggacatggacatcgtcgccagcgagcacctcctgcaccagtccctcgtggggaagcagagccccttccagaacgcgtacaacgtgaagggcaacgccacctccgccaacatcatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17051 - RNA, 1831 nt, synthetic construct
  misc_feature 1..1831: note = mRNA product Design2 comprising derived and/or modified sequence from CCHFV(Turkey-Kelkit06)__GQ337053.1__N (opt1)
  source 1..1831: mol_type = other RNA
ggggcgctgcctacggaggtggcagccatctccttctcggcatcaagcttaccatggagaacaagatcgaggtgaacagcaaggacgagatgaacaagtggttcgaggagttcaagaagggcaacgggctgatggacaccttcaccaactcctacagcttctgcgagaacgtccccaacctcgacaagttcgtgttccagatggcctccgccacggacgacgcgcagaaggacagcatctacgcctccgccctggtggaggccaccaagttctgcgccccgatctacgagtgcgcgtgggtcagctccaccggcatcgtgaagaaggggctggagtggttcgagaaggacagcggcaccatcaagtcctgggacgagaactacgccgagctcaaggtggacgtccccaagatcgagcagctggccaactaccagcaggccgcgctgaagtggcgcaaggacatcgggttccgggtgaacgccaacacggccgccctcagcaacaaggtgctggccgagtacaaggtccccggcgagatcgtgatgtccgtgaaggagatgctgagcgacatgatccgccggcgcaacctcatcctgaaccggggcggggacgagaacccccgcggcccggtctcccgggagcacgtggagtggtgccgcgagttcgtgaaggggaagtacatcatggcgttcaacccgccctggggcgacatcaacaagagcgggcggtccggcatcgccctggtcgccaccggcctcgccaagctggccgagaccgaggggaagggcgtgttcgacgaggcgaagaagaccgtggaggccctgaacgggtacctcgacaagcaccgcgacgaggtcgacaaggccagcgccgactccatgatcacgaacctgcccaagcacatcgccaaggcgcaggagctgtacaagaacagctccgccctccgggcccagggcgcccagatcgacacccccttcagcagcttctactggctgtacaaggccggcgtgacccccgagaccttccccacgatctcccagttcctgttcgagctcggggagcagccccgcggcaccaagaagatgaagaaggcgctgctgagcaccccgatgaagtgggggaagaagctctacgagctgttcgccgacgactccttccagcagaaccggatctacatgcaccccgccgtgctgaccgccggccgcatcagcgagatgggggtctgcttcggcacgatccccgtggcgaaccccgacgacgccgcccagggctccgggcacaccaagagcatcctcaacctgcggacctccaccgagacgaacaacccgtgcgccaagaccatcgtgaagctgttcgagatccaggagaccggcttcaacatccaggacatggacatcgtcgccagcgagcacctcctgcaccagtccatcgtggggaagcagagccccttccagaacgcgtacaacgtcaagggcaacgccacctccgccaacatcatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17052 - RNA, 5437 nt, synthetic construct
  misc_feature 1..5437: note = mRNA product Design2 comprising derived and/or modified sequence from CCHFV(10200)__U39455.2__GP (opt1) R6076
  source 1..5437: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgcccccaccgtgcggacctccctgccgaacagcccctccacgcccagcacgccccaggacacccaccacccggtgcgcaacctcctgtccgtcaccagccccgggcccgacgagaccagcaccccctccggcaccggcaaggagagctccgccaccagctccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgcccggcaccctctccaccaccgagagcacgccggccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacacccccgggccgaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatccccggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggttccggcgcctcctgagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17053 - RNA, 5437 nt, synthetic construct
  misc_feature 1..5437: note = mRNA product Design2 comprising derived and/or modified sequence from CCHFV(IbAr10200)__AF467768.2__GP (opt1)
  source 1..5437: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagacccgccacaacaagacggacaccatgaccacccccggggacaacccgagctccgagccgcccgtgagcacggccctgtccatcaccctggaccccagcaccgtcacccccacgacccccgcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccctccggcaccggcaaggagagctccgccaccagctccccgcaccccgtgagcaaccggcccccgacgccgcccgcgaccgcccaggggcccaccgagaacgactcccacaacgccaccgagcaccccgagagcctgacgcagtccgccacccccggcctcatgaccagccccacccagatcgtgcacccgcagtccgcgacccccatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcgcctgggctccgagctggggtgctacaccatcaaccgggtccgcagcttcaagctgtgcgagaactccgcgaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggccttcctcttctggttctccttcgggtacgtgatcacgtgcatcctgtgcaaggccatcttctacctgctcatcatcgtgggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgcctgaccagcgacggcctcgcccggcacgtgatccagtgccccaagcgcaaggagaaggtggaggagaccgagctgtacctgaacctcgagcggatcccgtgggtcgtgcgcaagctgctgcaggtctccgagagcacgggcgtcgccctcaagcggtccagctggctgatcgtgctgctcgtgctgttcaccgtctccctgagccccgtgcagtccgcgcccatcgggcagggcaagaccatcgaggcctaccgcgcccgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgcgaccatggaggtgtccaaccgcgccctgttcatccggagcatcatcaacaccacgttcgtcctctgcatcctgatcctggccgtgtgcgtggtctccaccagcgccgtggagatggagaacctccccgccgggacctgggagcgcgaggaggacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccctggggcgccatcaacgtgcagagcacctacaagcccaccgtgtccaccgccaacatcgcgctgagctggagctccgtcgagcaccgcgggaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacgtgcaccggcgactgccccgagcgctgcgggtgcacgagctccacgtgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccgcccgagatcatcaccctccacccccgcatcgaggaggggttcttcgacctgatgcacgtgcagaaggtcctgagcgcgtccaccgtgtgcaagctccagagctgcacgcacggcgtccccggggacctgcaggtctaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcccacggggacacgccgcagctggacctcaaggcccgccccacctacggcgcgggggagatcaccgtcctggtggaggtggccgacatggagctgcacaccaagaagatcgagatctccggcctcaagttcgccagcctggcctgcacgggctgctacgcctgctccagcgggatctcctgcaaggtccggatccacgtggacgagcccgacgagctgaccgtgcacgtcaagagcgacgaccccgacgtggtggcggcctccagctccctcatggcccgcaagctggagttcggcaccgacagcaccttcaaggccttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgcgaaggccagctgctggctggagtccgtgaagtccttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgcgggctgttcaagtaccggcacctgaaggacgacgaggagaccggctaccgccggatcatcgagaagctcaacaacaagaagggcaagaacaagctgctggacggggagcgcctcgccgaccggcgcatcgccgagctgttcagcacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17054 - RNA, 5449 nt, synthetic construct
  misc_feature 1..5449: note = mRNA product Design2 comprising derived and/or modified sequence from CCHFV(Turkey-Kelkit06)__GQ337054.1__GP (opt1) R6075
  source 1..5449: mol_type = other RNA
ggggcgctgcctacggaggtggcagccatctccttctcggcatcaagcttaccatgcccaccaacatcatgcacaccccgctggtgtgcttcatcctctacctgcagctgctctgcctgggcggggcccacggccagctgaacgccacggagcacaacgggaccaacaacaccaccgcgcccggcgccagccagtcccccaagcccccgatgagcacgaccccgccccacgcccccgagtccagcaccatcaagccgaccacgcccatctccgaggccgaggggagcggcgagaccacctccccgcccaacaccacgcagggcctcagctccccggagaccaccagcgagcgccccgccaccacgtccatcagcacctccagcaccgactccaccaaccccacgacccagatgaccgacaacacccccacgccgaccgtcagcacctcccccagctccagccccagcaccccctccacgccgcaggggatccaccaccccgcgcggagcctgctgtccgtgagctcccccaagaccgtgaccacccccacgccgaccagccccggcgagatgtccagcgagacctccagccagcactccgccatgagccgcatccccaccccgcacacggccacccgggtctccaccgagatcaccaaccaccgcaccccgcggcagagcgagtccagcgcccagcagacgaccccctcccccatgaccagcccggcgcagtccatcctcctgatgagcgccgcccccaccgccgtgcaggacatccaccccagccccacgaaccgctccaagcggaacctggagaccgagatcatcctcaccctgagccaggggctgaagaagtactacggcaagatcctcaagctgctgcacctcaccctggagcaggacacggaggggctgctcgagtggtgcaagggcaacctgggctccaactgcgacgacgacttcttccagaagcgcatcgaggagttcttcatgaccggggagtgctacttcaacgaggtgctgcagttcaagaccctcagcaccctgtccccgacggagcccagccacgcccggctgcccaccgcggagcccttcaagtcctacttcgccaagggcttcctcagcatcgactccgggtacttcagcgccaagtgctacccgcgctccagcgcctccggcctgcagctgatcaacgtcacccagcaccccgcccggatcgcggagacccccggccccaagacgaccagcctcaagaccatcaactgcatcaacctgcgcgcctccgtgttcaaggagcaccgggaggtggagatcaacgtcctgctcccgcagatcgccgtgaacctgagcaactgccacgtggtcatcaactcccacgtgtgcgactacagcctggacaccgacgggcccgtgcgcctcccccggatctaccacgagggcacgttcatccccgggacctacaagatcgtcatcgacaagaagaacaagctgaacgaccgctgcaccctggtgaccaactgcgtgatcaagggccgggaggtccgcaaggggcagagcgtgctccggcagtacaagacggagatcaagatcggcaaggcctccaccggcttccgcaagctgctgagcgaggagccgggggacgactgcatctcccggacccagctcctgcgcaccgagacggccgagatccacgacgacaactacggcgggcccggcgacaagatcaccatctgcaacgggagcaccatcgtggaccagcgcctgggctccgagctcggctgctacaccatcaaccgggtcaagagcttcaagctgtgcaagaactccgcgacggggaagacctgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcacgggcgacatcctggtggactgctccgggggccagcagcacttcctgaaggacaacctcatcgacctggggtgcccgcacatccccctgctcggccggatggccatctacatctgccgcatgagcaaccacccccggaccaccatggccttcctgttctggttctccttcggctacgtcatcacgtgcatcttctgcaaggccctgttctacagcctcatcatcatcgggaccctgggcaagaagatcaagcagtaccgcgagctgaagccccagacgtgcaccatctgcgagaccgcgccggtgaacgccatcgacgccgagatgcacgacctcaactgctcctacaacatctgcccctactgcgccagccggctgacctccgacgggctggcgcgccacgtgacgcagtgccccaagcggaaggagaaggtcgaggagaccgagctctacctgaacctggagcgcatcccgtggatcgtgcggaagctcctccaggtgagcgagagcaccggcgtcgccctgaagcgctccagctggctcatcgtgctgctggtgctcctgaccgtctccctgagccccgtgcagtccgcccccgtggggcacggcaagacgatcgagatctaccagacccgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccgtactgccgccactgctccgccgaccgggagatccaccagctgcacctgagcatctgcaagaagcgcaagaccggctccaacgtcatgctcgcggtgtgcaagcggatgtgcttccgcgccacgatcgaggccagccgccgggccctgctgatccgcagcatcatcaacaccaccttcgtgatctgcatcctcaccctgacgatctgcgtcgtgtccaccagcgccgtggagatggagaacctgcccgcgggcacctgggagcgggaggaggacctcaccaacttctgccaccaggagtgccaggtcacggagaccgagtgcctgtgcccctacgaggccctggtgctccgcaagcccctgttcctggactccatcgtgaaggggatgaagaacctcctgaacagcacctccctggagaccagcctctccatcgaggccccgtggggcgccatcaacgtccagagcacgttcaagcccaccgtgtccaccgccaacatcgcgctgagctggtccagcgtggtccaccgggggaacaagatcctggtgaccggccgctccgagagcatcatgaagctcgaggagcggacgggggtgtcctgggacctgggcgtcgaggacgccagcgagtccaagctgctcaccgtgagcatcatggacctgtcccagatgtacagccccgtgttcgagtacctgagcggcgaccgccaggtcgaggagtggcccaaggcgacctgcaccggggactgcccggagcggtgcggctgcacgtccagcacgtgcctccacaaggagtggtcccacagccgcaactggcggtgcaaccccacctggtgctggggcgtgggcaccgggtgcacgtgctgcggcgtggacgtcaaggacctgttcaccgaccacatgttcgtgaagtggaaggtggagtacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaggagggcttcttcgacctgatgcacgtccagaaggtgctcagcgcctccaccgtgtgcaagctgcagagctgcacgcacgggatccccggcgacctgcaggtctaccacatcggcaacctcctgaagggggaccgggtgaacggccacctgatccacaagatcgagtcccacttcaacaccagctggatgtcctgggacgggtgcgacctcgactactactgcaacatgggcgactggccgagctgcacctacaccggggtcacgcagcacaaccacgccgccttcgtgaacctgctgaacatcgagaccgactacaccaagaccttccacttccactccaagcgcgtgacggcgcacggcgacaccccgcagctcgacctgaaggcccggcccacctacggcgccgggggcatcaccgtcctggtggaggtggccgacatggagctccacacgaagaaggtcgagatcagcgggctgaagttcgcctccctggcgtgcaccggctgctacgcctgcagctccgggatcagctgcaaggtgcgcatccacgtggacgagcccgacgagctcaccgtccacgtcaagagctccgacccggacgtggtcgccgccagcacctccctgatggcccggaagctggagttcggcacggacagcaccttcaaggcgttctccgccatgcccaagaccagcctctgcttctacatcgtggagcgcgagtactgcaagtcctgcagcgaggacgacacccagaagtgcgtggacacgcggctggagcagccccagtccatcctgatcgagcacaagggcaccatcatcgggaagcagaacgacacgtgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacgcggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17055 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (opt1) R6077
  source 1..3961: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagaccagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17056 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (opt1) R6078
  source 1..3934: mol_type = other RNA
ggggcgctgcctacggaggtggcagccatctccttctcggcatcaagcttaccatggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17057 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (opt1) R6081
  source 1..3355: mol_type = other RNA
ggggcgctgcctacggaggtggcagccatctccttctcggcatcaagcttaccatggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17058 - RNA, 1411 nt, synthetic construct
  misc_feature 1..1411: note = mRNA product Design2 comprising derived and/or modified sequence from CCHVF(10200)__U39455.2__IgE-leader_Gn (opt1) R6079
  source 1..1411: mol_type = other RNA
ggggcgctgcctacggaggtggcagccatctccttctcggcatcaagcttaccatggactggacctggatcctgttcctcgtggccgccgcgacccgcgtccacagcagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17059 - RNA, 2371 nt, synthetic construct
  misc_feature 1..2371: note = mRNA product Design2 comprising derived and/or modified sequence from CCHVF(10200)__U39455.2__IgE-leader_Gc (opt1) R6080
  source 1..2371: mol_type = other RNA
ggggcgctgcctacggaggtggcagccatctccttctcggcatcaagcttaccatggactggacctggatcctgttcctcgtggccgccgcgacccgcgtccacagcttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctcctccacgtgcctgcacaaggagtggccccacagccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17060 - RNA, 1831 nt, synthetic construct; identical to SEQ ID NO: 17050
  misc_feature 1..1831: note = mRNA product Design2 comprising derived and/or modified sequence from CCHFV(10200)__NC_005302.1/U88410.1__N (opt1)
  source 1..1831: mol_type = other RNA

SEQ ID NO: 17061 - RNA, 1831 nt, synthetic construct; identical to SEQ ID NO: 17051
  misc_feature 1..1831: note = mRNA product Design2 comprising derived and/or modified sequence from CCHFV(Turkey-Kelkit06)__GQ337053.1__N (opt1)
  source 1..1831: mol_type = other RNA

SEQ ID NO: 17062 - RNA, 5437 nt, synthetic construct
  misc_feature 1..5437: note = mRNA product Design2 comprising derived and/or modified sequence from CCHFV(10200)__U39455.2__GP (opt1)
  source 1..5437: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgacgtcgacccctccacccagacggccgggggcaccagcgcccccaccgtgcggacctccctgccgaacagcccctccacgcccagcacgccccaggacacccaccacccggtgcgcaacctcctgtccgtcaccagccccgggcccgacgagaccagcaccccctccggcaccggcaaggagagctccgccaccagctccccgcaccccgtgagcaaccggccgcccacgccgcccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgcccggcaccctctccaccaccgagagcacgccggccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacacccccgggccgaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatccccggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggttccggcgcctcctgagcgaggagccgtccgacgactgcgtgagccggacccagctgctccgcaccgagaccgccgagatccacggcgacaactacgggggccccggcgacaagatcacgatctgcaacgggtccaccatcgtcgaccagcgcctgggcagcgagctggggtgctacaccatcaaccgggtgcgctccttcaagctgtgcgagaacagcgcgaccggcaagaactgcgagatcgactccgtgcccgtcaagtgccggcagggctactgcctccgcatcacgcaggaggggcggggccacgtgaagctgagccgcgggagcgaggtggtcctggacgcctgcgacacctcctgcgagatcatgatccccaagggcaccggggacatcctcgtggactgcagcggcggccagcagcacttcctgaaggacaacctgatcgacctcgggtgcccgaagatccccctgctgggcaagatggccatctacatctgccggatgtccaaccaccccaagaccacgatggccttcctcttctggttcagcttcgggtacgtgatcacgtgcatcctgtgcaaggccatcttctacctgctcatcatcgtcggcaccctggggcgccggctgaagcagtaccgcgagctcaagccccagacctgcaccatctgcgagaccaccccggtgaacgcgatcgacgccgagatgcacgacctgaactgctcctacaacatctgcccctactgcgccagccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgttcaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaaggggctggtggacagcgtcggcaactccttcttccccggcctgagcatctgcaagacgtgcagcatctccagcatcaacgggttcgagatcgagtcccacaagtgctactgcagcctcttctgctgcccgtactgccggcactgctccaccgacaaggagatccacaagctgcacctgagcatctgcaagaagcgcaagaccggctccaacgtgatgctcgccgtgtgcaagctgatgtgcttccgcgcgaccatggaggtcagcaaccgggccctgttcatccgctccatcatcaacacgaccttcgtgctctgcatcctgatcctggccgtgtgcgtcgtgagcacctccgccgtggagatggagaacctccccgccgggacctgggagcgggaggaggacctgacgaacttctgccaccaggagtgccaggtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcctggagcagcgtggagcaccgggggaacaagatcctcgtgtccggccgcagcgagtccatcatgaagctggaggagcggaccgggatcagctgggacctgggcgtcgaggacgcctccgagagcaagctcctgaccgtgtccgtgatggacctgagccagatgtactcccccgtcttcgagtacctcagcggggaccgccaggtggaggagtggcccaaggcgacctgcacgggcgactgcccggagcggtgcggctgcacctccagcacgtgcctgcacaaggagtggccccactcccgcaactggcggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccagtgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtctgcaagctccagtcctgcacccacggggtgcccggcgacctccaggtgtaccacatcgggaacctgctgaagggcgacaaggtcaacgggcacctgatccacaagatcgagccccacttcaacaccagctggatgagctgggacggctgcgacctggactactactgcaacatgggcgactggccctcctgcacctacacgggggtgacccagcacaaccacgccagcttcgtgaacctcctgaacatcgagaccgactacaccaagaacttccacttccactccaagcgcgtcacggcccacggcgacacgccccagctggacctcaaggcccggccgacctacggggcgggcgagatcaccgtgctggtggaggtcgccgacatggagctgcacaccaagaagatcgagatcagcgggctcaagttcgcctccctggcctgcaccggctgctacgcctgcagctccagcatctcctgcaaggtgcgcatccacgtggacgagcccgacgagctgaccgtccacgtcaagagcgacgaccccgacgtggtggcggcctccagctccctcatggcccggaagctggagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctcgagcagccgcagtccatcctgatcgagcacaaggggacgatcatcggcaagcagaactccacgtgcaccgcgaaggccagctgctggctggagagcgtcaagagcttcttctacgggctgaagaacatgctctccggcatcttcggcaacgtgttcatggggatcttcctgttcctggcccccttcatcctcctgatcctgttcttcatgttcggctggcggatcctcttctgcttcaagtgctgccgccgcacccgggggctgttcaagtaccgccacctgaaggacgacgaggagaccggctaccggcgcatcatcgagaagctcaacaacaagaaggggaagaacaagctgctggacggcgagcggctcgccgacggccgcatcgccgagctgttcagcaccaagacccacatcgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17063 - RNA, 5437 nt, synthetic construct
  misc_feature 1..5437: note = mRNA product Design2 comprising derived and/or modified sequence from CCHFV(IbAr10200)__AF467768.2__GP (opt1)
  source 1..5437: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagacccgccacaacaagacggacaccatgaccacccccggggacaacccgagctccgagccccccgtgagcacggccctgtccatcaccctggaccccagcaccgtcaccccgacgacccccgcgtccggcctcgaggggagcggcgaggtgtacacctccccccccatcaccacgggcagcctgccgctgtccgagaccacccccgagctccccgtgaccacggggaccgacaccctgagcgccggcgacgtcgacccctccacccagacggccgggggcaccagcgccccgaccgtgcggacctccctgcccaacagcccctccacgcccagcaccccgcaggacacccaccaccccgtgcgcaacctcctgtccgtcaccagccccgggcccgacgagacgagcaccccgtccggcaccggcaaggagagctccgccaccagctccccccaccccgtgagcaaccggcccccgacgccccccgcgaccgcccaggggcccaccgagaacgactcccacaacgccaccgagcacccggagagcctgacgcagtccgccacccccggcctcatgaccagccccacccagatcgtgcacccgcagtccgcgacccccatcacggtccaggacacccaccccagccccaccaaccgctccaagcggaacctgaagatggagatcatcctgaccctcagccaggggctgaagaagtactacggcaagatcctgcgcctcctgcagctgacgctcgaggaggacaccgagggcctgctggagtggtgcaagcggaacctcgggctggactgcgacgacaccttcttccagaagcgcatcgaggagttcttcatcaccggcgaggggcacttcaacgaggtgctgcagttccggacgccgggcaccctctccaccaccgagagcacgcccgccgggctgcccaccgccgagcccttcaagtcctacttcgccaagggcttcctgagcatcgactccggctactacagcgccaagtgctacagcgggacctccaacagcggcctccagctgatcaacatcacccgccactccacgcggatcgtggacaccccggggcccaagatcaccaacctgaagaccatcaactgcatcaacctcaaggcgagcatcttcaaggagcaccgcgaggtcgagatcaacgtgctgctgccccaggtggccgtcaacctctccaactgccacgtggtgatcaagagccacgtctgcgactactccctggacatcgacggcgccgtgcggctgccccacatctaccacgagggggtgttcatcccgggcacgtacaagatcgtcatcgacaagaagaacaagctcaacgaccgctgcaccctgttcaccgactgcgtgatcaagggccgggaggtgcgcaaggggcagagcgtcctgcggcagtacaagaccgagatccgcatcggcaaggcctccacggggagccggcgcctcctgtccgaggagcccagcgacgactgcatctcccggacccagctgctccgcaccgagaccgccgagatccacggcgacaactacgggggccccggcgacaagatcacgatctgcaacgggagcaccatcgtggaccagcgcctgggctccgagctggggtgctacaccatcaaccgggtccgcagcttcaagctgtgcgagaactccgcgaccggcaagaactgcgagatcgacagcgtgcccgtgaagtgccggcagggctactgcctccgcatcacgcaggaggggcggggccacgtcaagctgagccgcgggtccgaggtggtgctggacgcctgcgacaccagctgcgagatcatgatcccgaagggcaccggggacatcctcgtcgactgctccggcggccagcagcacttcctgaaggacaacctgatcgacctcgggtgccccaagatccccctgctgggcaagatggccatctacatctgccggatgagcaaccaccccaagaccacgatggccttcctcttctggttctccttcgggtacgtgatcacctgcatcctgtgcaaggccatcttctacctgctcatcatcgtgggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgcctgaccagcgacggcctcgcccggcacgtgatccagtgccccaagcgcaaggagaaggtggaggagaccgagctgtacctgaacctcgagcggatcccgtgggtcgtgcgcaagctgctgcaggtgtccgagagcacgggcgtcgccctcaagcggtccagctggctgatcgtgctgctcgtgctgttcaccgtctccctgagccccgtgcagtccgcgcccatcgggcagggcaagaccatcgaggcctaccgcgcccgggaggggtacaccagcatctgcctcttcgtgctgggctccatcctgttcatcgtcagctgcctcatgaaggggctggtggactccgtgggcaacagcttcttcccgggcctgagcatctgcaagacgtgctccatcagctccatcaacgggttcgagatcgagagccacaagtgctactgctccctcttctgctgcccctactgccgccactgcagcaccgacaaggagatccacaagctgcacctgtccatctgcaagaagcggaagaagggcagcaacgtcatgctcgccgtgtgcaagctgatgtgcttccgcgcgaccatggaggtgtccaaccgcgccctgttcatccggagcatcatcaacaccacgttcgtcctctgcatcctgatcctggccgtgtgcgtggtctccaccagcgccgtggagatggagaacctccccgccgggacctgggagcgcgaggaggacctgaccaacttctgccaccaggagtgccaggtgacggagaccgagtgcctgtgcccctacgaggcgctcgtcctgcggaagccgctgttcctcgactccaccgccaagggcatgaagaacctgctgaacagcacctccctcgagacgagcctgtccatcgaggccccctggggggccatcaacgtgcagagcacctacaagcccaccgtgtccaccgccaacatcgcgctgagctggagctccgtcgagcaccgcggcaacaagatcctcgtgagcggccggtccgagagcatcatgaagctggaggagcgcacggggatctcctgggacctgggcgtggaggacgccagcgagtccaagctcctgaccgtcagcgtgatggacctgtcccagatgtacagccccgtgttcgagtacctctccggggaccggcaggtcggcgagtggccgaaggccacctgcaccggcgactgccccgagcgctgcgggtgcacgagctccacctgcctgcacaaggagtggccccacagccggaactggcgctgcaaccccacctggtgctggggcgtggggaccggctgcacgtgctgcgggctggacgtgaaggacctcttcaccgactacatgttcgtcaagtggaaggtggagtacatcaagaccgaggccatcgtgtgcgtcgagctgacctcccaggagcggcagtgcagcctgatcgaggccggcacgcgcttcaacctcggcccggtgaccatcaccctgtccgagccccggaacatccagcagaagctgccccccgagatcatcaccctccacccgcgcatcgaggaggggttcttcgacctgatgcacgtgcagaaggtcctgagcgcgtccaccgtgtgcaagctccagagctgcacgcacggcgtccccggggacctgcaggtgtaccacatcggcaacctgctcaagggggacaaggtgaacggccacctgatccacaagatcgagccccacttcaacaccagctggatgtcctgggacggctgcgacctggactactactgcaacatgggggactggcccagctgcacctacaccggcgtcacgcagcacaaccacgcctccttcgtgaacctcctgaacatcgagaccgactacaccaagaacttccacttccacagcaagcgggtgaccgcccacggggacacgccgcagctggacctcaaggcccgccccacctacggcgcgggggagatcaccgtcctggtggaggtggccgacatggagctgcacaccaagaagatcgagatctccggcctcaagttcgccagcctggcctgcacgggctgctacgcctgctccagcgggatctcctgcaaggtccggatccacgtggacgagcccgacgagctgaccgtgcacgtcaagagcgacgaccccgacgtggtggcggcctccagctccctcatggcccgcaagctggagttcggcaccgacagcaccttcaaggccttctccgccatgccgaagacgagcctgtgcttctacatcgtcgagcgggagcactgcaagtcctgcagcgaggaggacaccaagaagtgcgtgaacaccaagctcgagcagccccagtccatcctgatcgagcacaaggggaccatcatcggcaagcagaacagcacgtgcaccgcgaaggccagctgctggctggagtccgtgaagagcttcttctacggcctgaagaacatgctctccgggatcttcggcaacgtcttcatggggatcttcctgttcctggcccccttcatcctcctgatcctgttcttcatgttcggctggcgcatcctcttctgcttcaagtgctgccggcgcacccgcgggctgttcaagtaccggcacctgaaggacgacgaggagaccggctaccgccggatcatcgagaagctcaacaacaagaagggcaagaacaagctgctggacggggagcgcctcgccgaccggcgcatcgccgagctgttcagcacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17064 - RNA, 5449 nt, synthetic construct
  misc_feature 1..5449: note = mRNA product Design2 comprising derived and/or modified sequence from CCHFV(Turkey-Kelkit06)__GQ337054.1__GP (opt1)
  source 1..5449: mol_type = other RNA
ggggcgctgcctacggaggtggcagccatctccttctcggcatcaagcttaccatgcccaccaacatcatgcacaccccgctggtgtgcttcatcctctacctgcagctgctctgcctgggcggggcccacggccagctgaacgccacggagcacaacgggaccaacaacaccaccgcgcccggcgccagccagtcccccaagcccccgatgagcacgacccccccccacgcccccgagtccagcaccatcaagccgaccacgcccatctccgaggccgaggggagcggcgagaccacctccccccccaacaccacgcagggcctcagctccccggagaccaccagcgagcgccccgccaccacgtccatcagcacctccagcaccgactccaccaaccccacgacccagatgaccgacaacacccccacgccgaccgtcagcacctcccccagctccagccccagcaccccctccacgccgcaggggatccaccaccccgcgcggagcctgctgtccgtgagctcccccaagaccgtgaccacccccacgccgaccagccccggcgagatgtccagcgagacctccagccagcactccgccatgagccgcatccccaccccccacacggccacccgggtctccaccgagatcaccaaccaccgcaccccgcggcagagcgagtccagcgcccagcagacgaccccctcccccatgaccagcccggcgcagtccatcctcctgatgagcgccgcccccaccgccgtgcaggacatccaccccagccccacgaaccgctccaagcggaacctggagaccgagatcatcctcaccctgagccaggggctgaagaagtactacggcaagatcctcaagctgctgcacctcaccctggagcaggacacggaggggctgctcgagtggtgcaagggcaacctgggctccaactgcgacgacgacttcttccagaagcgcatcgaggagttcttcatgaccggggagtgctacttcaacgaggtgctgcagttcaagaccctcagcaccctgtccccgacggagcccagccacgcccggctgcccaccgcggagcccttcaagtcctacttcgccaagggcttcctcagcatcgactccgggtacttcagcgccaagtgctacccgcgctccagcgcctccggcctgcagctgatcaacgtcacccagcaccccgcccggatcgcggagacccccggccccaagacgaccagcctcaagaccatcaactgcatcaacctgcgcgcctccgtgttcaaggagcaccgggaggtggagatcaacgtcctgctcccgcagatcgccgtgaacctgagcaactgccacgtggtcatcaactcccacgtgtgcgactacagcctggacaccgacgggcccgtgcgcctcccccggatctaccacgagggcacgttcatccccgggacctacaagatcgtcatcgacaagaagaacaagctgaacgaccgctgcaccctggtgaccaactgcgtgatcaagggccgggaggtccgcaaggggcagagcgtgctccggcagtacaagacggagatcaagatcggcaaggcctccaccggcttccgcaagctgctgagcgaggagccgggggacgactgcatctcccggacccagctcctgcgcaccgagacggccgagatccacgacgacaactacggcgggcccggcgacaagatcaccatctgcaacgggagcaccatcgtggaccagcgcctgggctccgagctcggctgctacaccatcaaccgggtcaagagcttcaagctgtgcaagaactccgcgacggggaagacctgcgaggtggacagcacccccgtgaagtgccgccagggcttctgcctgaagatcacccaggaggggcggggccacgtcaagctctcccgcgggagcgaggtggtcctggacgcctgcgactccagctgcgaggtgatgatccccaagggcacgggcgacatcctggtggactgctccgggggccagcagcacttcctgaaggacaacctcatcgacctggggtgcccgcacatccccctgctcggccggatggccatctacatctgccgcatgagcaaccacccccggaccaccatggccttcctgttctggttctccttcggctacgtcatcacctgcatcttctgcaaggccctgttctacagcctcatcatcatcgggaccctgggcaagaagatcaagcagtaccgcgagctgaagccccagacgtgcaccatctgcgagaccgcgccggtgaacgccatcgacgccgagatgcacgacctcaactgctcctacaacatctgcccctactgcgccagccggctgacctccgacgggctggcgcgccacgtgacgcagtgccccaagcggaaggagaaggtcgaggagaccgagctctacctgaacctggagcgcatcccgtggatcgtgcggaagctcctgcaggtgagcgagagcaccggcgtcgccctgaagcgctccagctggctcatcgtgctgctggtgctcctgaccgtctccctgagccccgtgcagtccgcccccgtggggcacggcaagacgatcgagatctaccagacccgggagggcttcgccagcatctgcctcttcatgctggggtccatcctgttcatcgtcagctgcctcgtgaagggcctggtggactccgtcagcgagtccttcttccccgggctgagcgtgtgcaagacctgctccatcggcagcgtgaacgggttcgagatcgagtcccacaagtgctactgcagcctcttctgctgcccgtactgccgccactgctccgccgaccgggagatccaccagctgcacctgagcatctgcaagaagcgcaagaccggctccaacgtcatgctcgcggtgtgcaagcggatgtgcttccgcgccacgatcgaggccagccgccgggccctgctgatccgcagcatcatcaacaccaccttcgtgatctgcatcctcaccctgacgatctgcgtcgtgtccaccagcgccgtggagatggagaacctgcccgcgggcacctgggagcgggaggaggacctcaccaacttctgccaccaggagtgccaggtcacggagaccgagtgcctgtgcccctacgaggccctggtgctccgcaagcccctgttcctggactccatcgtgaaggggatgaagaacctcctgaacagcacctccctggagaccagcctctccatcgaggccccgtggggcgccatcaacgtccagagcacgttcaagcccaccgtgtccaccgccaacatcgcgctgagctggtccagcgtggtccaccgggggaacaagatcctggtgaccggccgctccgagagcatcatgaagctcgaggagcggacgggggtgtcctgggacctgggcgtcgaggacgccagcgagtccaagctgctcaccgtgagcatcatggacctgtcccagatgtacagccccgtgttcgagtacctgagcggcgaccgccaggtcgaggagtggcccaaggccacctgcaccggggactgcccggagcggtgcggctgcacgtccagcacctgcctccacaaggagtggtcccacagccgcaactggcggtgcaaccccacctggtgctggggggtgggcaccgggtgcacgtgctgcggcgtggacgtcaaggacctgttcaccgaccacatgttcgtgaagtggaaggtggagtacatcaagaccgaggccatcgtctgcgtggcgctgacctcccaggagcgccagtgcagcctcatcgaggccggcacccggttcaacctggggcccgtgacgatcaccctgtccgagccccgcaacatccagcagaagctcccgcccgagatcatcaccctgcaccccaagatcgaggagggcttcttcgacctgatgcacgtccagaaggtgctcagcgcctccaccgtgtgcaagctgcagagctgcacgcacgggatccccggcgacctgcaggtctaccacatcggcaacctcctgaagggggaccgggtgaacggccacctgatccacaagatcgagtcccacttcaacaccagctggatgtcctgggacgggtgcgacctcgactactactgcaacatgggcgactggccgagctgcacctacaccggggtcacgcagcacaaccacgccgccttcgtgaacctgctgaacatcgagaccgactacaccaagaccttccacttccactccaagcgcgtgacggcgcacggcgacaccccccagctcgacctgaaggcccggcccacctacggcgccgggggcatcaccgtcctggtggaggtggccgacatggagctccacacgaagaaggtcgagatcagcgggctgaagttcgcctccctggcgtgcaccggctgctacgcctgcagctccgggatcagctgcaaggtgcgcatccacgtggacgagcccgacgagctcaccgtccacgtgaagagctccgacccggacgtggtcgccgccagcacctccctgatggcccggaagctggagttcggcacggacagcaccttcaaggcgttctccgccatgcccaagaccagcctctgcttctacatcgtggagcgcgagtactgcaagtcctgcagcgaggacgacacccagaagtgcgtggacacgcggctggagcagccccagtccatcctgatcgagcacaagggcaccatcatcgggaagcagaacgacacctgcaccgccaaggccagctgctggctcgagtccgtcaagagcttcttctacggcctgaagaacatgctggggtccgtgttcggcaacctcttcatcgggatcctgctgttcctcgcgcccttcgtgctgctggtcctgttcttcatgttcggctggaagatcctcttctgcttcaagtgctgccgccgcacgcggggcctgttcaagtaccgccacctgaaggacgacgaggagaccgggtaccggcgcatcatcgagcggctcaacagcaagaagggcaagaaccgcctgctggacggggaccggctcgccgaccgcaagatcgccgagctgttctccaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17065 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (opt1)
  source 1..3961: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagaccagcgaggagccctccgacgactgcgtgagccgcacgcagctgctgcggaccgagaccgccgagatccacggggacaactacggcgggccgggcgacaagatcaccatctgcaacggctccacgatcgtcgaccagcgcctcgggagcgagctgggctgctacaccatcaaccgggtgcgctccttcaagctgtgcgagaacagcgcgaccgggaagaactgcgagatcgactccgtgcccgtcaagtgccggcagggctactgcctccgcatcacccaggaggggcggggccacgtgaagctgagccgcggctccgaggtggtcctggacgcctgcgacacgagctgcgagatcatgatccccaaggggaccggcgacatcctcgtggactgctccgggggccagcagcacttcctgaaggacaacctgatcgacctcggctgccccaagatcccgctgctggggaagatggccatctacatctgccggatgagcaaccaccccaagaccaccatggccttcctcttctggttctccttcggctacgtgatcacgtgcatcctgtgcaaggccatcttctacctgctcatcatcgtcgggaccctgggccgccggctgaagcagtaccgcgagctcaagccccagacctgcaccatctgcgagacgacccccgtgaacgcgatcgacgccgagatgcacgacctgaactgcagctacaacatctgcccgtactgcgcctcccggctgaccagcgacgggctcgcccgccacgtgatccagtgccccaagcggaaggagaaggtcgaggagaccgagctgtacctgaacctcgagcgcatcccctgggtggtgcggaagctgctgcaggtctccgagagcacgggcgtggcgctcaagcgcagctcctggctgatcgtgctgctcgtcctgttcaccgtgagcctgtcccccgtgcagagcgccccgatcggccaggggaagaccatcgaggcctaccgggcccgcgagggctacacctccatctgcctcttcgtcctggggagcatcctgttcatcgtgtcctgcctcatgaagggcctggtggacagcgtcgggaactccttcttccccggcctgagcatctgcaagacgtgctccatcagctccatcaacggcttcgagatcgagagccacaagtgctactgctccctcttctgctgcccctactgccggcactgcagcaccgacaaggagatccacaagctgcacctgtccatctgcaagaagcgcaagaccgggagcaacgtgatgctcgccgtctgcaagctgatgtgcttccgcgcgaccatggaggtgtccaaccgggccctgttcatccgcagcatcatcaacacgaccttcgtgctgtgcatcctcatcctggccgtctgcgtggtgagcacctccgccgtcgagatggagaacctgcccgccggcacctgggagcgggaggaggacctcacgaacttctgccaccaggagtgccaggtgaccgagaccgagtgcctgtgcccgtacgaggcgctggtgctccgcaagcccctgttcctggacagcaccgccaaggggatgaagaacctcctgaactccacgagcctggagacctccctcagcatcgaggccccctggggcgccatcaacgtccagtccacctacaagcccaccgtgagcaccgccaacatcgcgctgtcctggagctccgtggagcaccgggggaacaagatcctggtcagcggccgctccgagagcatcatgaagctcgaggagcggacgggcatctcctgggacctgggggtggaggacgccagcgagtccaagctgctcaccgtgagcgtcatggacctgagccagatgtactccccggtgttcgagtacctgagcggcgaccgccaggtggaggagtggcccaaggccacctgcaccggggactgccccgagcggtgcggctgcacgtccagcacctgcctccacaaggagtggccccactcccgcaactggcggtgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacgcggttcaacctggggcccgtcaccatcaccctcagcgagccccgcaacatccagcagaagctgcccccggagatcatcaccctgcacccccggatcgaggagggcttcttcgacctcatgcacgtgcagaaggtgctgtccgcgagcacggtctgcaagctgcagtcctgcacccacggcgtgcccggggacctccaggtgtaccacatcggcaacctgctgaagggggacaaggtcaacggccacctcatccacaagatcgagccgcacttcaacaccagctggatgtcctgggacgggtgcgacctggactactactgcaacatgggcgactggcccagctgcacctacacgggcgtgacccagcacaaccacgcctccttcgtgaacctgctcaacatcgagaccgactacaccaagaacttccacttccacagcaagcgcgtcacggcccacggggacaccccccagctggacctgaaggcccggcccacctacggcgcgggggagatcaccgtgctcgtggaggtcgccgacatggagctgcacacgaagaagatcgagatctccggcctgaagttcgccagcctcgcctgcaccgggtgctacgcctgctccagcagcatctcctgcaaggtgcgcatccacgtggacgagccggacgagctgaccgtccacgtgaagagcgacgaccccgacgtggtcgcggcctccagctccctgatggcccggaagctcgagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctggagcagccccagtccatcctcatcgagcacaagggcacgatcatcgggaagcagaacagcacctgcaccgcgaaggcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcgcatcctcttctgcttcaagtgctgccggcgcacccggggcctgttcaagtaccgccacctgaaggacgacgaggagaccgggtaccggcgcatcatcgagaagctcaacaacaagaagggcaagaacaagctgctggacggggagcggctcgccgacggccgcatcgccgagctgttctccacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17066 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (opt1)
  source 1..3934: mol_type = other RNA
ggggcgctgcctacggaggtggcagccatctccttctcggcatcaagcttaccatggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctgcaggtgagcgagtccacgggggtcgccctcaagcggagcagctggctgatcgtgctgctcgtgctgttcaccgtctccctgagccccgtgcagtccgccccgatcggccaggggaagaccatcgaggcctaccgcgcgcgggagggctacaccagcatctgcctcttcgtgctgggctccatcctgttcatcgtcagctgcctcatgaaggggctggtggactccgtcggcaacagcttcttccccgggctgtccatctgcaagacgtgcagcatctccagcatcaacggcttcgagatcgagtcccacaagtgctactgcagcctcttctgctgcccctactgccgccactgctccaccgacaaggagatccacaagctgcacctgagcatctgcaagaagcgcaagaccgggtccaacgtgatgctcgccgtgtgcaagctgatgtgcttccgggccaccatggaggtcagcaaccgcgccctgttcatccggtccatcatcaacacgaccttcgtgctctgcatcctgatcctggccgtgtgcgtcgtgagcaccagcgcggtggagatggagaacctgcccgccggcacctgggagcgcgaggaggacctcacgaacttctgccaccaggagtgccaggtcaccgagaccgagtgcctgtgcccgtacgaggccctggtgctccggaagcccctgttcctggactccaccgccaagggcatgaagaacctcctgaacagcacgtccctggagaccagcctctccatcgaggccccctggggggcgatcaacgtgcagagcacctacaagcccaccgtctccaccgccaacatcgccctgagctggtccagcgtggagcaccgcggcaacaagatcctggtgtccgggcggagcgagtccatcatgaagctcgaggagcgcacgggcatcagctgggacctgggggtcgaggacgcctccgagagcaagctgctcaccgtgtccgtgatggacctgagccagatgtacagcccggtcttcgagtacctgtccggcgaccggcaggtggaggagtggcccaaggccacctgcaccggcgactgccccgagcgctgcgggtgcacgagctccacctgcctccacaaggagtggccccacagccggaactggcgctgcaacccgacctggtgctggggcgtggggaccggctgcacgtgctgcggcctggacgtcaaggacctgttcaccgactacatgttcgtgaagtggaaggtggagtacatcaagaccgaggcgatcgtctgcgtggagctcacctcccaggagcggcagtgcagcctgatcgaggccgggacgcgcttcaacctgggccccgtgaccatcaccctctccgagccccggaacatccagcagaagctgcccccggagatcatcaccctgcacccccgcatcgaggaggggttcttcgacctcatgcacgtccagaaggtgctgagcgcctccacggtgtgcaagctgcagagctgcacccacggcgtccccggggacctccaggtgtaccacatcggcaacctgctgaagggcgacaaggtgaacgggcacctcatccacaagatcgagccgcacttcaacacctcctggatgagctgggacggctgcgacctggactactactgcaacatgggggactggccctcctgcacctacacgggcgtcacccagcacaaccacgccagcttcgtgaacctgctcaacatcgagaccgactacaccaagaacttccacttccactccaagcgggtgacggcgcacggggacaccccccagctggacctgaaggcccgccccacctacggcgccggcgagatcaccgtcctcgtggaggtggccgacatggagctgcacacgaagaagatcgagatcagcgggctgaagttcgcctccctcgcgtgcaccggctgctacgcctgcagctccagcatcagctgcaaggtccggatccacgtggacgagccggacgagctgaccgtgcacgtcaagtccgacgaccccgacgtggtggccgccagctccagcctgatggcccgcaagctcgagttcgggaccgactccacgttcaaggcgttcagcgccatgcccaagacctccctgtgcttctacatcgtcgagcgcgagcactgcaagagctgctccgaggaggacaccaagaagtgcgtgaacaccaagctggagcagccccagagcatcctcatcgagcacaagggcacgatcatcgggaagcagaactccacctgcaccgccaaggccagctgctggctggagtccgtgaagagcttcttctacggcctgaagaacatgctctccggcatcttcgggaacgtcttcatgggcatcttcctgttcctggccccgttcatcctcctgatcctgttcttcatgttcgggtggcggatcctcttctgcttcaagtgctgccgccggacccgcggcctgttcaagtaccggcacctgaaggacgacgaggagaccgggtaccgccggatcatcgagaagctcaacaacaagaagggcaagaacaagctgctggacggcgagcgcctcgcggacgggcggatcgccgagctgttcagcacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17067 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (opt1)
  source 1..3355: mol_type = other RNA
ggggcgctgcctacggaggtggcagccatctccttctcggcatcaagcttaccatggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctgcaggtgagcgagtccacgggggtcgccctcaagcggagcagctggctgatcgtgctgctcgtgctgttcaccgtctccctgagccccgtgcagtccgccccgatcggccgcaagcccctcttcctggacagcaccgccaaggggatgaagaacctgctcaactccaccagcctggagacgtccctgagcatcgaggcgccctggggcgccatcaacgtgcagtccacctacaagcccaccgtcagcaccgccaacatcgccctctcctggagctccgtggagcaccggggcaacaagatcctggtcagcgggcgctccgagagcatcatgaagctggaggagcgcacgggcatctcctgggacctcggggtggaggacgccagcgagtccaagctgctgaccgtgagcgtcatggacctcagccagatgtactccccggtgttcgagtacctgagcggcgaccggcaggtggaggagtggcccaaggcgacctgcaccggggactgccccgagcgctgcggctgcacgtccagcacctgcctgcacaaggagtggccccactcccggaactggcgctgcaacccgacctggtgctggggcgtcgggaccggctgcacgtgctgcgggctggacgtgaaggacctcttcaccgactacatgttcgtgaagtggaaggtcgagtacatcaagaccgaggccatcgtgtgcgtggagctgaccagccaggagcggcagtgctccctgatcgaggccggcacccgcttcaacctcgggcccgtcacgatcaccctgagcgagccccggaacatccagcagaagctgcccccggagatcatcaccctccacccccgcatcgaggagggcttcttcgacctgatgcacgtgcagaaggtgctgtccgccagcaccgtctgcaagctccagtcctgcacgcacggcgtgcccggggacctgcaggtgtaccacatcggcaacctgctcaagggggacaaggtcaacggccacctgatccacaagatcgagccccacttcaacaccagctggatgtcctgggacggctgcgacctggactactactgcaacatgggggactggccgagctgcacctacaccggcgtgacgcagcacaaccacgcctccttcgtgaacctcctgaacatcgagaccgactacaccaagaacttccacttccacagcaagcgggtcaccgcgcacggggacacgccccagctggacctcaaggcccgccccacctacggcgccggggagatcaccgtgctggtggaggtcgccgacatggagctgcacaccaagaagatcgagatctccggcctcaagttcgccagcctggcgtgcacgggctgctacgcctgcagctccagcatctcctgcaaggtgcggatccacgtggacgagccggacgagctgaccgtccacgtgaagagcgacgaccccgacgtggtcgccgcctccagctccctcatggcgcgcaagctggagttcgggaccgacagcaccttcaaggccttctccgccatgcccaagacgagcctgtgcttctacatcgtggagcgggagcactgcaagtcctgcagcgaggaggacaccaagaagtgcgtgaacaccaagctcgagcagccccagtccatcctgatcgagcacaagggcaccatcatcgggaagcagaacagcacgtgcaccgccaaggcctcctgctggctggagagcgtcaagtccttcttctacggcctcaagaacatgctgagcgggatcttcggcaacgtgttcatgggcatcttcctgttcctcgcgccgttcatcctgctgatcctcttcttcatgttcgggtggcgcatcctgttctgcttcaagtgctgccggcgcacccggggcctgttcaagtaccgccacctcaaggacgacgaggagaccgggtaccggcgcatcatcgagaagctgaacaacaagaagggcaagaacaagctgctcgacggggagcgcctggccgacggccggatcgccgagctgttctccacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17068 - RNA, 1411 nt, synthetic construct
  misc_feature 1..1411: note = mRNA product Design2 comprising derived and/or modified sequence from CCHVF(10200)__U39455.2__IgE-leader_Gn (opt1)
  source 1..1411: mol_type = other RNA
ggggcgctgcctacggaggtggcagccatctccttctcggcatcaagcttaccatggactggacctggatcctgttcctcgtggccgccgcgacccgcgtccacagctccgaggagcccagcgacgactgcgtgtcccggacgcagctgctgcgcaccgagaccgccgagatccacggcgacaactacgggggcccgggggacaagatcaccatctgcaacggcagcacgatcgtggaccagcggctcgggtccgagctgggctgctacaccatcaaccgcgtccggagcttcaagctgtgcgagaactccgccaccggcaagaactgcgagatcgacagcgtgcccgtgaagtgccgccaggggtactgcctccggatcacccaggagggccgcgggcacgtcaagctgtcccggggcagcgaggtggtgctggacgcctgcgacacgtcctgcgagatcatgatccccaaggggaccggcgacatcctcgtcgactgcagcggcgggcagcagcacttcctgaaggacaacctgatcgacctcggctgccccaagatcccgctgctggggaagatggccatctacatctgccgcatgtccaaccaccccaagaccaccatggcgttcctcttctggttcagcttcggctacgtgatcacgtgcatcctgtgcaaggccatcttctacctgctcatcatcgtgggcaccctggggcggcgcctgaagcagtaccgggagctcaagccccagacctgcaccatctgcgagacgacccccgtcaacgccatcgacgccgagatgcacgacctgaactgctcctacaacatctgcccgtactgcgcgagccgcctgacctccgacggcctcgcccggcacgtgatccagtgccccaagcgcaaggagaaggtggaggagaccgagctgtacctgaacctcgagcggatcccctgggtcgtgcgcaagctgctccaggtgagcgagtccacgggggtcgccctgaagcggagcagctggctgatcgtgctgctcgtgctgttcaccgtctccctgagccccgtgcagtccgccccgatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17069 - RNA, 2371 nt, synthetic construct
  misc_feature 1..2371: note = mRNA product Design2 comprising derived and/or modified sequence from CCHVF(10200)__U39455.2__IgE-leader_Gc (opt1)
  source 1..2371: mol_type = other RNA
ggggcgctgcctacggaggtggcagccatctccttctcggcatcaagcttaccatggactggacctggatcctgttcctcgtggccgccgcgacccgcgtccacagcttcctggactccacggccaagggcatgaagaacctgctcaacagcacctccctggagaccagcctgtccatcgaggccccctggggcgccatcaacgtgcagagcacctacaagccgacggtgtccaccgccaacatcgcgctcagctggtccagcgtcgagcaccgggggaacaagatcctggtgtccgggcgcagcgagtccatcatgaagctggaggagcggaccggcatcagctgggacctcggggtggaggacgcctccgagagcaagctgctgaccgtctccgtgatggacctcagccagatgtactcccccgtgttcgagtacctgagcggcgaccgccaggtcgaggagtggcccaaggccacgtgcaccggcgactgccccgagcggtgcgggtgcaccagctccacgtgcctgcacaaggagtggccgcacagccgcaactggcggtgcaaccccacctggtgctggggcgtggggaccggctgcacgtgctgcgggctcgacgtgaaggacctgttcaccgactacatgttcgtcaagtggaaggtggagtacatcaagaccgaggccatcgtgtgcgtcgagctgacctcccaggagcgccagtgcagcctcatcgaggcgggcacccggttcaacctgggccccgtgaccatcacgctgtccgagccccgcaacatccagcagaagctcccgcccgagatcatcaccctgcacccccggatcgaggaggggttcttcgacctgatgcacgtgcagaaggtcctcagcgcctccaccgtgtgcaagctgcagagctgcacccacggcgtgcccggggacctgcaggtctaccacatcggcaacctcctgaagggcgacaaggtgaacgggcacctgatccacaagatcgagccgcacttcaacacgtcctggatgagctgggacggctgcgacctcgactactactgcaacatgggggactggccctcctgcacctacaccggcgtgacccagcacaaccacgccagcttcgtcaacctgctgaacatcgagacggactacaccaagaacttccacttccactccaagcgcgtgaccgcccacggggacacgccccagctcgacctgaaggcccggcccacctacggcgcgggcgagatcaccgtcctggtggaggtggccgacatggagctccacaccaagaagatcgagatcagcgggctgaagttcgcctccctggcctgcaccggctgctacgcctgcagctccagcatctcctgcaaggtccgcatccacgtggacgagccggacgagctcacggtgcacgtcaagagcgacgaccccgacgtggtggcggccagctccagcctgatggcccggaagctggagttcgggaccgactccaccttcaaggccttcagcgccatgcccaagacctccctctgcttctacatcgtcgagcgcgagcactgcaagagctgctccgaggaggacaccaagaagtgcgtgaacacgaagctggagcagccccagagcatcctgatcgagcacaagggcaccatcatcgggaagcagaactccacgtgcaccgcgaaggccagctgctggctcgagtccgtcaagagcttcttctacggcctgaagaacatgctgtccggcatcttcgggaacgtgttcatgggcatcttcctcttcctggccccgttcatcctgctgatcctcttcttcatgttcgggtggcggatcctgttctgcttcaagtgctgccgccggacccgcggcctgttcaagtaccggcacctcaaggacgacgaggagaccgggtaccgccgcatcatcgagaagctgaacaacaagaagggcaagaacaagctgctcgacggcgagcggctggccgacgggcgcatcgccgagctgttcagcaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17070 - RNA, 1831 nt, synthetic construct
  misc_feature 1..1831: note = mRNA product Design2 comprising derived and/or modified sequence from CCHFV(10200)__NC_005302.1/U88410.1__N (opt5)
  source 1..1831: mol_type = other RNA
ggggcgctgcctacggaggtggcagccatctccttctcggcatcaagcttaccatggagaacaagatcgaagtgaataacaaagacgagatgaatagatggttcgaagagtttaagaaaggcaacgggctggtcgataccttcacaaatagctactccttttgcgaatctgttcccaacctcgaccggttcgtgtttcagatggccagcgctacggatgacgcccaaaaggattccatttatgcgtctgctctggtggaggccaccaaattctgtgcccctatctacgagtgcgcttgggtcagctccacaggaattgtgaagaagggccttgaatggtttgagaaaaatgccgggaccatcaagtcttgggacgaaagctatacagagctgaaagttgatgtgccgaagattgagcagctcaccggataccagcaggctgccctgaaatggcgcaaggacatcggcttcagagtcaacgcgaatacagccgctctttccaacaaggtgctggccgaatataaagttcccggggagatcgtgatgagcgtcaaggaaatgctctctgatatgattcggcgcagaaatctgatcctgaaccggggaggcgacgagaatcctcgcggccccgtgtcccacgaacacgtggattggtgtagagagtttgtcaaagggaagtacattatggctttcaaccctccctggggagacatcaataaaagcggccggtctgggattgccctcgttgcgaccggactggccaaacttgctgagacggaaggcaaagggatctttgatgaggccaagaagaccgtggaagctctgaacggatatctcgacaaacacaaggacgaggtggatcgcgcctccgccgacagcatgattacaaacctgcttaaacatatcgctaaggcgcaagaactgtacaaaaattcttccgccctcagagctcagagcgcccagatcgataccgccttctcctcttactattggctgtacaaggctggcgtcacacctgagacctttccgacggtgagccagttcctgttcgagctcggcaagcaaccccgggggacaaagaagatgaaaaaggccctgctttccacccctatgaaatggggaaagaagctgtatgaactctttgcggacgatagcttccagcagaaccgcatttacatgcaccccgctgttctgacagccggcagaatctctgagatgggggtgtgctttggaaccattcctgtcgccaatcccgacgatgctgcccagggctccgggcataccaaaagcatccttaacctgcggacaaatacggaaaccaacaatccgtgtgctaagacaattgtgaaactcttcgaggttcaaaagaccggatttaacatccaggacatggatatcgtggcctctgaacatctgctgcaccagagcctcgtcggcaaacaatcccctttccagaatgcgtataacgtgaagggcaatgccacatctgctaacattatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17071 - RNA, 1831 nt, synthetic construct
  misc_feature 1..1831: note = mRNA product Design2 comprising derived and/or modified sequence from CCHFV(Turkey-Kelkit06)__GQ337053.1__N (opt5)
  source 1..1831: mol_type = other RNA
ggggcgctgcctacggaggtggcagccatctccttctcggcatcaagcttaccatggagaacaagatcgaagtgaatagcaaagacgagatgaacaagtggttcgaagagtttaaaaagggcaatgggctgatggataccttcacaaactcctactctttttgcgaaaatgtccccaacctcgacaaattcgtttttcagatggccagcgctacggatgacgcccaaaaggattccatttatgcgtctgctctggtggaggccaccaagttctgtgcccctatctacgagtgcgcttgggtgagctccacaggaattgtcaaaaagggccttgaatggtttgagaaagactctgggaccatcaagagctgggatgaaaattatgccgagctgaaagtggacgttccgaagattgagcagctcgctaactaccagcaggccgcgctgaagtggagaaaagatatcggattccgggtgaatgccaacacagctgccctttccaataaggtcctggctgaatataaagtgcccggcgagatcgttatgagcgtgaaggaaatgctctctgacatgattcgcagacggaacctgatcctgaatcgcgggggagatgagaaccctagaggccccgtctcccgggaacacgtggagtggtgtcgcgagtttgtgaaaggcaagtacattatggccttcaatcctccctggggagacatcaacaaaagcgggagatctggcattgcgctcgtcgccaccgggctggctaaacttgccgaaacagagggaaagggcgtttttgatgaagctaagaagaccgtggaggccctgaacgggtatctcgacaaacatcgggacgaagtggataaggcctccgctgacagcatgatcacgaatctgcctaaacacattgcgaaggcccaagagctttacaagaactcttccgctctgcgcgcccagggagcccagatcgataccccgttcagctccttttactggctctataaagctggcgtcacacccgagaccttccctacaatctctcagttcctgtttgaactgggcgagcaacccagagggaccaagaaaatgaagaaagccctcctgagcacgcctatgaagtggggaaagaaactttacgaactgttcgcggacgattcctttcagcagaatcggatttatatgcatcccgctgtgctcacagccggccgcatcagcgagatgggggtttgcttcggaaccattccggtggccaaccctgacgatgctgcccagggctctgggcacacaaagtccatcctgaatcttagaaccagcaccgaaacaaacaatccctgtgctaaaacgattgtcaagctgtttgagatccaagagaccggattcaacatccaggacatggatattgtggcctctgaacatctcctgcaccagagcatcgttggcaaacaatccccttttcagaatgcgtacaacgtgaagggcaatgccacatctgctaacattatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17072 - RNA, 5437 nt, synthetic construct
  misc_feature 1..5437: note = mRNA product Design2 comprising derived and/or modified sequence from CCHFV(10200)__U39455.2__GP (opt5)
  source 1..5437: mol_type = other RNA
ggggcgctgcctacggaggtggcagccatctccttctcggcatcaagcttaccatgcacatcagcctgatgtacgccattctctgcctgcagctttgtggcctgggggagacccatggatcccacaacgaaacaagacataataagacggacaccatgacaacccacggcgataacccctctagcgagcctccggtgtccacagctctctctatcaccctggaccccagcacagtcacccctacgacccccgcctccgggcttgaaggatctggcgaggtttatacaagccctcccattaccacagggtccctgcctctcagcgaaaccacgccggagctgcccgtgacaaccggaacagataccctgtctgcgggcgacgtggatccttccacccagacagctggcgggacgagcgcccccaccgtccggacatctctccctaattcccccagcaccccgtctacacctcaggacacccatcaccccgtgcgcaacctgctttccgttacgagccctggacccgatgagacatccaccccctctggcaccgggaaagaaagctccgccacaagctctcctcacccggtgtccaatagaccccctacaccccctgctaccgcccagggacccacggagaacgacagccataatgctaccgaacacccggagtctctgacacagagcgccacccctggcctcatgacatcccccacccaaatcgtccatcctcagtctgcgacgcccattaccgtgcaggatacacaccctagccccaccaaccggtccaagcgcaatctgaaaatggagatcatccttacactgagccaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacaccgggcaccctctctaccacagagtccacgcctgccgggctgcccaccgctgaacccttcaagagctactttgccaaaggattcctgtctatcgactccggctattacagcgctaagtgctattccgggacatctaacagcggactccagctgattaatatcacccggcattccacacgcattgtggacacccctggcccgaaaatcacgaaccttaagacaatcaattgtattaacctgaaggcctctatctttaaagagcacagagaagtcgagattaacgtgctcctgccccaagtggcggtcaatcttagcaactgccatgttgtgatcaagtcccacgtgtgtgattacagcctggacattgatggcgccgtccggctccctcatatctaccacgagggggtgttcatccccggaacctataaaattgttatcgacaagaaaaataagctgaacgatcgctgcaccctgtttacagactgtgtgattaaaggcagagaagtccggaaggggcagtctgtgctccgccagtacaagaccgagatcagaattggaaaggcttccacaggcttccggagactgcttagcgaggaaccttctgatgactgcgtttcccgcacgcaactgctccggaccgaaacagccgagatccacggggataattatggcggacccggcgacaagatcaccatttgtaacgggagcacaatcgtggatcagagactgggatctgagctgggctgctacaccattaatcgcgtccggagctttaaactttgcgaaaactccgctacggggaagaattgtgagatcgacagcgtgcctgtcaaatgcagacagggatattgtctccgcattacccaggaaggccgggggcatgtgaagctgtctagaggctccgaggttgtgctggacgcctgcgatacaagctgtgagatcatgattcccaagggaaccggcgacatcctcgtcgattgctccgggggacaacagcacttcctgaaagacaaccttatcgatctgggctgtccgaagattcctctcctggggaaaatggccatctacatttgccgcatgtctaatcatcccaagacaaccatggctttcctgttttggttcagctttggatatgtgatcacatgtattctttgcaaagcgatcttctacctcctgatcattgttggcaccctggggcggagactcaagcagtaccgcgaactgaagcctcagacgtgtacaatctgcgagaccacccccgtgaacgccattgacgctgaaatgcacgatcttaattgctcctataacatctgtccgtactgcgcctctcggctgacaagcgacggcctcgccagacacgtcattcaatgtcctaaacggaaggagaaagtggaagagaccgagctgtatctgaatcttgaacgcatcccctgggtggttagaaagctcctgcaggtctccgagtctacgggagtggctctgaaacggagctcctggctcatcgtgctgcttgtcctgtttacagtgagcctctctcctgttcagtccgcccccattggccaggggaagaccatcgaagcgtacagagctcgcgagggatatacaagcatttgcctgttcgtgctgggctctatcctttttattgtctcctgtctcatgaaggggctggtggatagcgttggaaactctttctttcccggcctgtccatctgcaaaacctgtagcatctccagcattaacgggttcgaaatcgagtctcataagtgctactgtagcctcttttgctgtccttattgccggcactgctccacagacaaagagattcataagctgcacctttctatctgtaaaaagagaaaaaccggcagcaatgtgatgctggccgtctgcaagctcatgtgtttccgcgccacgatggaagtgtccaacagagctctgtttattcggtctatcattaataccacattcgttctgtgcatccttatcctggccgtgtgtgtcgtgagcacctccgctgtggagatggaaaacctcccggccggaacatgggagcgcgaagaggatctgaccaatttctgccatcaagagtgtcaggtcacggaaacagagtgcctctgtccctacgaagcgctggttcttagaaagcctctgtttctcgactctaccgccaaaggcatgaagaacctgctgaatagcacatcccttgagaccagcctgtctattgaggctccctggggagccatcaacgtgcagtccacctacaaacctacagtgagcacggctaatattgccctctcttggtccagcgtcgaacaccggggaaacaagatcctggtgtccggccgctctgagagcattatgaaactcgaagagagaaccgggatctcctgggatctgggagttgaagacgcgagcgagtctaaacttctgacagtgtccgtcatggacctcagccagatgtattctcccgtgttcgagtacctgagcggcgatcggcaagttgaagagtggcctaaggctacctgcacaggcgactgtccggaacgctgcgggtgcacctcctctacgtgtctgcacaaagagtggccccatagcagaaattggcggtgcaaccctacatggtgttggggagtgggcaccgggtgcacctgttgcggacttgatgtcaaggacctgtttacagattatatgttcgtgaaatggaaggttgaatacatcaaaaccgaggccattgtgtgtgtcgagctcacatcccaggaacgccagtgctctctgatcgaggccggcacgagatttaatctcgggcccgtgaccattacactgagcgaacctcggaacatccaacagaaacttcccccggagattatcaccctgcaccctagaatcgaagagggattctttgacctgatgcatgtgcagaaggtcctctccgctagcacagtttgtaaactgcagtcttgcacccacggcgtgcccggcgatcttcaagtgtatcatattgggaatctgctcaagggagacaaagtcaacggccacctgatccacaagattgagccccatttcaacacgtcctggatgagctgggatgggtgtgacctcgattactattgcaatatgggagactggccttcctgcacctacacaggcgtgacccagcacaaccatgcctcttttgttaatctgcttaacatcgaaacagattacaccaaaaatttccactttcacagcaagcgcgtgacagcccatggggacacgccccagctggacctgaaggctcggcctacctatggagcgggcgagattacagtcctcgtggaagttgccgatatggagctgcacaccaaaaagatcgagatttccggccttaaattcgcttctctggcctgtaccgggtgctacgcctgtagctccagcatctcttgcaaggtgagaatccatgtcgacgaaccggatgagctcacagtgcacgtcaaatccgacgatcccgacgtggttgctgcctctagctccctgatggcgcgcaagctcgaatttggaacggatagcaccttcaaggctttctctgccatgcctaagacaagcctgtgtttttatattgtggagcgggaacattgcaagtcctgttctgaggaggacaccaaaaagtgcgtcaacacaaaacttgaacagccccaaagcatcctgattgagcacaagggcaccatcattgggaaacaaaattccacgtgtacagccaaggctagctgctggctggaatccgtgaagtctttcttttacggactcaaaaacatgctgagcggcatcttcgggaatgtttttatgggaatcttcctttttctggcccctttcattctcctgatcctctttttcatgtttggctggcgcattctgttctgtttcaagtgctgcagacggaccagaggcctttttaaatatcgccacctgaaggatgacgaggaaaccgggtaccggagaatcattgagaaactgaacaataagaaggggaaaaacaagctcctggatggcgagcggcttgcggacgggcgcatcgctgaactgttctccacaaaaacccatatcggatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17073 - RNA, 5437 nt, synthetic construct
  misc_feature 1..5437: note = mRNA product Design2 comprising derived and/or modified sequence from CCHFV(IbAr10200)__AF467768.2__GP (opt5)
  source 1..5437: mol_type = other RNA
ggggcgctgcctacggaggtggcagccatctccttctcggcatcaagcttaccatgcacatcagcctgatgtacgccattctctgcctgcagctttgtggcctgggggagacccatggatcccacaacgaaacaagacataataagacggacaccatgacaacccccggcgataacccttctagcgagccgcccgtgtccacagctctctctatcaccctggaccctagcacagtcacccccacgacccctgcctccgggcttgaaggatctggcgaggtttatacatctccccctattaccacagggtccctgccgctcagcgaaaccacgcccgagctgcctgtgacaaccggaacagataccctgtctgcgggcgacgtggatccctccacccagacagctggcgggacgagcgcccctaccgtccggacatctctccccaattccccgagcaccccttctacaccccaggacacccaccatcctgtgcgcaacctgctttccgttacgagccccggacccgatgagacatccaccccttctggcaccgggaaagaaagctccgccacaagctctccgcaccccgtgtccaatagacctcccacccctcccgctacagcccagggaccgacggagaacgacagccacaatgctaccgaacatcctgagtctctgacacagagcgccacccccggcctcatgacatcccctacccaaatcgtccacccccagtctgcgacgcctattaccgtgcaggatacacatcccagcccgaccaaccggtccaagcgcaatctgaaaatggagatcatccttacactgagccaggggctcaagaaatactatggaaagattctgagactgctccaactgacccttgaagaggacacggaaggcctgctcgagtggtgcaagcggaacctgggccttgattgtgacgatacattctttcagaaacgcatcgaagagttctttattaccggggagggacacttcaatgaagttctgcagtttagaacacctggcaccctctctaccacagagtccacgcccgccgggctgcccaccgctgaacctttcaagagctactttgccaaaggattcctgtctatcgactccggctattacagcgctaagtgctattccgggacatctaacagcggactccagctgattaatatcacccggcactccacacgcattgtggacaccccgggccccaaaatcacgaaccttaagacaatcaattgtattaacctgaaggcctctatctttaaagagcatagagaagtcgagattaacgtgctcctgcctcaagtggcggtcaatcttagcaactgccacgttgtgatcaagtcccatgtgtgtgattacagcctggacattgatggcgccgtccggctcccccacatctaccatgagggggtgttcatccctggaacctataaaattgttatcgacaagaaaaataagctgaacgatcgctgcaccctgtttacagactgtgtgattaaaggcagagaagtccggaaggggcagtctgtgctccgccagtacaagaccgagatcagaattggaaaggcttccacaggcagccggagactgctttctgaggaaccctccgatgactgcatcagccgcacgcaactgctccggaccgaaacagccgagatccacggggataattatggcggacctggcgacaaaattaccatctgtaacgggtctacaattgttgatcagagactgggaagcgagctgggctgctacaccatcaatcgcgtgcggtccttcaaactttgcgaaaacagcgctacggggaagaattgtgagattgactctgtccccgtgaaatgcagacagggatattgtctccgcatcacccaggaaggccgggggcacgtcaagctgtccagaggcagcgaggtggttctggacgcctgcgatacatcctgtgagattatgatcccgaagggaaccggcgacatcctcgtggattgctctgggggacaacagcattttctgaaagacaaccttattgatctgggctgtcctaagatccccctcctggggaaaatggccatttacatctgccgcatgagcaatcaccctaagacaaccatggctttcctgttctggttttccttcggatatgtcattacatgtatcctttgcaaagcgatcttttacctcctgattatcgtgggcaccctggggaagcggctcaagcagtacagagaactgaaaccccagacgtgtacaatttgcgagaccaccccggttaacgccatcgacgctgaaatgcatgatcttaattgctcttataacatttgtccttactgcgccagccgcctgacatccgacggcctcgcccggcacgtgatccaatgtcccaagagaaaagagaaggtcgaagagaccgagctgtatctgaatcttgaacggatcccttgggtggtgcgcaaactcctgcaggtttctgagagcacgggagtcgctctgaagagatccagctggctcattgtgctgcttgtgctgttcacagtctctctctcccccgtgcagagcgcccccatcggccaggggaagaccattgaagcgtaccgggctagagagggatatacatctatctgcctgtttgttctgggctccattcttttcatcgtgagctgtctcatgaaagggctggtcgattctgtgggaaactcctttttccctggcctgagcatctgcaagacctgttccattagctctatcaacgggtttgaaattgagagccacaaatgctactgttccctcttctgctgtccgtattgccgccattgctctacagacaaggagatccacaaactgcatcttagcatttgtaagaaacggaagaagggctccaatgttatgctggccgtgtgcaaactcatgtgttttagagccaccatggaagtctctaaccgcgctctgttcatcagaagcattatcaatacgacctttgtgctgtgcatccttattctggccgtttgtgtggtctccacatctgctgtggagatggaaaacctccccgccggaacctgggagcgggaagaggatctgacaaatttctgccaccaagagtgtcaggtgaccgaaacggagtgcctctgtccttacgaagcgctggtccttcgcaagcccctgttcctcgacagcacagccaaaggcatgaagaacctgcttaattccaccagcctggagacatctctgtccatcgaggctccttggggagccattaacgttcagagcacctacaaacccaccgtgtctacagctaatatcgccctctcctggagctccgtggaacatagagggaacaagattctggtctctggccggagcgagtccatcatgaagctcgaggaacgcacggggatcagctgggatctgggagtggaagacgcgtctgagtccaaacttctgaccgttagcgtgatggacctctctcagatgtatagccctgtctttgagtacctgtccggcgatagacaagtgggcgaatggccgaaggccacatgcaccggggactgtcccgagcggtgcggatgcacatctagcacctgtctgcacaaagaatggcctcactcccgcaattggagatgcaaccccacgtggtgttggggcgttgggacaggatgcacctgttgcggccttgatgtgaaggacctgttcaccgattatatgtttgtcaaatggaaggtggagtacattaagacagaagctatcgtttgtgtggagctcacctctcaggagcggcagtgcagcctgattgaagccgggacacgcttcaatctcggacctgtcacgatcaccctgtccgagcccagaaacattcaacagaaacttccgcctgaaatcatcacactgcatccccggattgaggaaggctttttcgacctgatgcacgtgcagaaggtgctcagcgcttctaccgtctgtaaactgcagtcctgcacacatggcgttcccggggatcttcaagtgtatcacatcggaaatctgctcaagggcgacaaagtgaacgggcatctgattcacaagatcgagcctcactttaacaccagctggatgtcctgggatggatgtgacctcgattactattgcaatatgggcgactggccctcttgcacgtacaccggggtcacacagcataaccacgccagcttcgtgaatctgcttaacattgagaccgattacacaaagaattttcatttccactccaaaagagttaccgcccacggagacacacctcagctggacctgaaggctcgcccgacgtatggcgcgggcgaaatcaccgtgctcgtcgaggtggccgatatggaactgcataccaaaaagattgagatctctgggcttaaatttgctagcctggcctgtacaggatgctacgcctgttccagcggcatctcttgcaaggttcggattcacgtggacgagcccgatgaactcaccgtccatgtgaaatccgacgatcctgacgtcgtggctgcctctagctccctgatggcgagaaagctcgagttcgggacagatagcacgtttaaggctttctctgccatgcccaaaaccagcctgtgtttctatatcgttgaacgcgagcactgcaagtcctgttctgaagaggacaccaaaaagtgcgtgaacacaaaacttgagcagcctcaaagcattctgatcgaacataagggaacaattatcggcaagcaaaattccacctgtacggccaaagctagctgctggctggagtccgtcaagagctttttctacgggctcaaaaacatgctgagcggaatctttggcaatgtgttcatgggcatttttcttttcctggccccctttatcctcctgattctcttctttatgttcgggtggcggatcctgttttgtttcaagtgctgcagacgcacacggggacttttcaaatatagacacctgaaggatgacgaagagaccggctaccgccggattatcgaaaagctgaacaataaaaaggggaaaaacaagctcctggatggagagagacttgcggaccggcgcatcgctgagctgttttccaccaaaacacacattggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17074 - RNA, 5449 nt, synthetic construct
  misc_feature 1..5449: note = mRNA product Design2 comprising derived and/or modified sequence from CCHFV(Turkey-Kelkit06)__GQ337054.1__GP (opt5)
  source 1..5449: mol_type = other RNA
ggggcgctgcctacggaggtggcagccatctccttctcggcatcaagcttaccatgcccaccaacatcatgcacacacctctggtgtgcttcattctctacctgcagcttctgtgtctcggcggggcccatggacaactgaatgctacggagcacaacggcaccaataacacaaccgccccgggggcgagccagtcccccaagcctcccatgtctacaacccctccccatgctcctgaaagctccacaatcaaaccgaccacgcccatttctgaggccgaaggaagcggcgagaccacatcccctcccaataccacacaggggctttctagccctgaaaccacgtccgagagacccgccacaaccagcatctctacatccagcaccgactctaccaacccgacaacgcagatgaccgataatacacctacccccacagtctccaccagcccttcttccagcccctccacgccctctacacctcaagggattcaccatccggctcggagcctgctctccgttagctctcccaagaccgtgaccacacctacccccacatcccctggcgagatgagctctgaaacgagctcccagcactctgccatgagccgcatccccaccccgcacacagctaccagagtgtccacagagatcaccaaccatcggacgcctcgccagagcgaatcttccgcccagcaaaccacacccagccctatgacctctcccgcgcagtccattctgctgatgagcgccgctcctacagccgtccaggacatccacccctccccgaccaatagatctaaacggaacctcgagacggagattatcctgacacttagccagggcctgaagaaatattacgggaagattctcaagctgcttcatctgaccctcgaacaagatacagagggactgctggaatggtgcaaaggcaatctcgggtccaactgtgacgatgactttttccagaagcgcatcgaggaatttttcatgaccggagagtgctattttaatgaggtgctgcagttcaaaaccctttctacactgagccctacggaaccctcccacgctagactccccaccgccgagccttttaagagctacttcgcgaaaggctttctgtctattgattccgggtatttcagcgccaagtgttacccgcggtcttccgctagcggacttcaactgatcaacgttacacagcaccccgcccgcatcgctgaaacccctggccccaagacaacctctctcaaaacgattaattgcatcaacctgagagccagcgtgtttaaggagcatcgggaagtcgagattaacgtgctgctccctcagatcgccgttaatctgtccaactgtcacgtggtcattaatagccatgtgtgcgactattctcttgatacagacggccccgtgcgcctgcctagaatctaccacgaggggaccttcatccccggaacctacaaaattgtcatcgataagaaaaacaagctcaatgaccggtgtacactggttaccaactgcgtgattaaaggccgcgaagtgagaaaggggcagtccgtccttcggcaatataagacagagatcaaaattggaaaggctagcacgggctttagaaaactgctctccgaggaaccgggggatgactgtatctctcgcacccagctgctgcggacagaaaccgcggagatccatgacgataattacggaggccctggcgacaagattacaatctgcaacgggagcaccattgtggatcagagactcggatccgagctgggctgctatacgatcaatcgcgttaaatctttcaaactttgtaagaacagcgccaccgggaagacatgcgaagtggactccacccccgtcaagtgtcggcagggattctgcctgaaaattacacaagagggcagagggcacgtgaagctctctcgcggcagcgaagttgtgctggatgcttgtgactccagctgcgaggtcatgatccctaaaggaaccggcgatattctggtggactgttctgggggacagcagcactttcttaaggataatctcatcgacctgggctgcccccatatcccgctgctcgggcggatggccatttacatctgtagaatgtccaaccaccctcgcacaaccatggccttcctgttttggttcagctttggatatgtcattacgtgcatcttctgtaaggctctgttttactctctgattatcatcggcacactcgggaaaaagattaaacagtatcgggagctgaagccccaaacctgcaccatctgcgaaacagcccctgtgaatgcgattgatgctgagatgcatgacctgaactgttcctacaatatctgcccctactgtgccagcagacttacctctgacggcctcgcccgccacgttacgcagtgccccaaacggaaggaaaaggtggaggaaacagagctgtatctgaacctcgagcggattccttggatcgtcagaaaactgcttcaggtgtccgaaagcaccggagttgctctgaagcgctccagctggctcatcgtgctgctggtccttctcacagtgtctctgagcccggtgcagtccgcccccgttggccacgggaaaaccattgagatctaccaaacaagagaaggattcgcttctatttgtctgtttatgctcggcagcatcctgttcattgtctcctgccttgtgaaggggctggtggattctgtcagcgagtcctttttccctggactctctgtgtgtaaaacctgcagcatcggctccgttaacgggtttgaaatcgagagccataagtgttattgctctctgttctgttgcccctactgccggcactgttccgccgacagagagattcatcagctgcaccttagcatctgcaaaaagcgcaagacgggctctaatgtgatgctcgcggtctgtaaacggatgtgcttcagagccaccattgaggcttcccgcagagccctgctgatccggagcattatcaacacaacctttgtgatttgtatcctcacactgaccatctgcgttgtgtccacgtctgctgtcgaaatggaaaatcttcctgccggaacatgggagcgcgaagaggatctgaccaacttctgtcatcaggagtgccaagtgacagaaaccgagtgtctctgcccctatgaagcgctggttctgagaaagcctctttttctggacagcattgtgaaaggcatgaagaatctcctgaactccaccagcctcgagacatctctgtccatcgaggccccgtggggagctattaatgtccagagcacgttcaaacccaccgtgtctacagccaacatcgctcttagctggtcctctgtggtccaccggggaaataagattctggttaccggccgcagcgaatccatcatgaagctcgaggaaagaacaggggtgtcttgggatctgggagtggaggacgccagcgaatccaaactgcttaccgtcagcatcatggatctgtctcagatgtactcccctgtgtttgagtatctcagcggcgaccggcaggttgaggaatggcccaaggccacgtgtacaggggattgccctgagcgctgcggctgtacctcctctacctgcctgcacaaagaatggagccattccagaaactggcggtgtaatcccacatggtgctggggagtgggcaccgggtgtacatgctgtggagtcgacgtgaaggatctcttcacggaccacatgtttgttaaatggaaggtggagtacattaagaccgaagctatcgtctgcgtggcgctgacatctcaagagcgccagtgtagccttattgaggccggcaccagattcaacctggggccggttacaatcaccctctccgaacctcggaatattcagcagaaactgcctcccgagatcatcacgctgcatcccaagattgaagagggatttttcgatcttatgcacgtgcaaaaagtcctgagcgcttctaccgtgtgcaagctccagtcctgtacacatggcatccccggcgaccttcaggtgtaccacattgggaacctcctgaaaggagacagagtcaatggccaccttatccataagattgaaagccactttaacacctcttggatgtcctgggatgggtgcgacctggattattactgcaacatgggagactggcctagctgtacatataccggcgttacacagcataatcacgccgccttcgtgaacctgctcaatatcgagacggattacaccaagacatttcacttccattctaaacgcgtgaccgctcacggggacaccccgcaactggatcttaaggcccggcccacatatggagcgggcggcattacggtcctggtggaggttgctgacatggaactccataccaaaaaggtggagatcagcgggctgaaattcgcctccctcgcctgcacaggatgttacgcttgctctagcggcatctcctgtaaggtccgcattcacgtggatgaacctgacgagctgaccgttcatgtgaaaagctccgatcccgacgtcgtggccgcgtctacaagccttatggctagaaagctggagtttgggaccgattccacgttcaaggccttttctgccatgcctaaaacaagcctgtgcttctatatcgtcgaacgggagtactgtaagtcctgctctgaagacgacacccagaaatgtgtggataccagactcgagcagccccaaagcattctgatcgaacacaagggaacaattatcggcaaacagaacgatacctgcacagctaaggcctcctgttggcttgagagcgttaagtcctttttctacgggctgaaaaatatgctcggatctgtgtttggcaacctgttcatcggcattctcctgtttcttgctccgttcgtcctgctggtgctctttttcatgttcgggtggaagatcctgttttgcttcaaatgctgtcgccggaccagaggactttttaagtatcgccacctgaaagacgacgaggaaacgggctaccggagaattatcgagcggctcaatagcaagaaggggaaaaaccgcctgctcgatggagacagactggccgatcggaagattgcggaacttttctctacaaaaacccatatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17075 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (opt5)
  source 1..3961: mol_type = other RNA
ggggcgctgcctacggaggtggcagccatctccttctcggcatcaagcttaccatgcacatcagcctgatgtacgccattctctgcctgcagctttgtggcctgggggagacccatggatcccacaacgaaacatctgaggaacccagcgacgattgcgtgtccagaacgcagctcctgcggaccgagacagctgaaatccatggcgacaattatgggggacctggcgataagattaccatctgtaacgggtctacaattgtcgaccagcgccttggaagcgagctgggctgctacaccatcaatagagttcggtccttcaaactctgtgagaactctgccacaggcaagaattgcgaaatcgatagcgtgccggtgaaatgtcgccaggggtattgcctgagaattacccaggagggacggggccacgtcaagctgtcccgcgggagcgaagtggttctcgacgcgtgtgatacgtcttgcgagatcatgattcccaaaggaaccggcgacatcctggtggattgttccgggggacaacagcattttcttaaggacaacctgattgatctcggctgccctaagatccccctgcttggcaaaatggctatttacatctgcagaatgagcaatcaccctaagacaaccatggccttcctgttttggttctcttttgggtatgtcatcacatgtattctctgcaaagccatcttctacctgctgattatcgtgggaaccctcggccggcgcctgaagcagtatagagagcttaaaccccagacgtgtacaatttgcgaaaccacacctgttaacgctatcgacgccgagatgcacgatctgaattgttcctacaacatctgcccgtactgtgctagccggctcacctctgacgggctggcccgccatgtgattcaatgccccaagagaaaggaaaaagtcgaggaaaccgagctttatctgaatctcgagcggatcccttgggtggtgcgcaagctgctgcaggtctccgaaagcacaggagttgcgctcaaaagatcctcttggctgattgtgcttctggtgctctttacggtcagcctgtcccccgtgcagagcgcccctatcggccaggggaagaccattgaggcttaccgggccagagaaggatatacatctatctgtcttttcgttctgggctccatcctctttattgtgagctgcctgatgaaaggcctggtcgactctgtggggaacagcttctttcccggactctccatctgtaagacctgctctattagctccatcaatggcttcgagattgaaagccacaaatgctactgttctctgttttgctgtccgtattgccgccattgttccacagataaggagatccacaagctccacctgagcatttgcaaaaagcggaaaaccgggtctaacgttatgctcgctgtgtgtaagctgatgtgcttcagagccacgatggaggtctccaatcgcgcgctgttcatccggagcatcattaacacaacctttgtgctttgtatcctcattctggccgtctgcgtggtttccacctctgctgtggaaatggagaacctgcctgccggaacatgggaaagagaggaagacctcaccaatttctgtcatcaagagtgccaggtcacagagacggaatgcctgtgtccctacgaggctcttgtgctgcgcaaacctctctttctggatagcaccgccaagggcatgaagaacctgcttaattccacatctctcgaaaccagcctgtccatcgaggccccctggggcgctattaacgttcagagcacatataaacccaccgtgtctacggcgaatatcgccctgtcctggagctctgtcgagcaccgggggaacaagatcctcgtgtccggaagaagcgaatctattatgaaactggaggaacgcaccggcatcagctgggaccttggggtggaggatgcttccgaaagcaagctgctcacagtttctgtcatggacctgtcccaaatgtacagccctgtgttcgagtacctgtccggagatagacaggtggaggaatggccgaaagctacctgcacaggcgactgtcccgagcggtgcgggtgtacctctagcacgtgccttcataaggaatggcctcactcccgcaattggcggtgtaaccccacatggtgctggggagtcggcaccgggtgtacatgctgtggcctcgatgtgaaggacctgtttaccgattatatgttcgttaaatggaaggtggagtacattaaaaccgaagccatcgtctgcgtggagctgacatctcaggagagacagtgcagcctcattgaagccggaacgcggtttaatctgggccctgttaccatcacactttccgagccccgcaacatccaacagaagctgccgcctgaaattatcaccctccatcccagaattgaggaagggttctttgacctgatgcacgtgcagaaagtcctgtctgccagcacagtgtgtaaacttcagtcctgcacccacggagttcctggcgacctccaagtgtatcatatcgggaatctgctgaagggagataaagtcaacggccacctcattcataagatcgagccccacttcaatacgagctggatgtcttgggacgggtgtgatctggactactattgcaacatgggcgattggccttcctgtacatacaccggagtgacccagcacaatcatgcgagctttgtgaaccttctgaacatcgagacagactataccaaaaatttccactttcattctaagcgggtcacagctcacggcgatacgccccagctcgacctgaaagccagaccgacctacggggccggagaaattacagttctggtggaggtggctgatatggaacttcataccaagaaaatcgagatttccggcctgaagttcgccagcctcgcttgcacagggtgttacgcctgttcttccagcatctcctgcaaggtccgcattcacgtggacgagcctgatgaactgaccgttcacgtgaaaagcgacgatcccgacgtcgtggcggcctctagctccctcatggctcggaagctggagttcggaacggactctacctttaaagccttcagcgctatgcccaagacatccctttgcttttatatcgttgaaagagagcattgtaaatcttgcagcgaagaggataccaagaagtgcgtgaacacaaaactggagcagcctcaatccattctcatcgaacacaagggcaccatcattgggaaacaaaattctacatgtaccgccaaggcgagctgctggctggagtccgtcaagagcttcttttacggcctgaagaacatgctttctggaatcttcggcaatgtgtttatggggattttcctgtttctcgccccgttcatcctgctcattctgtttttcatgtttggatggcgcatccttttctgtttcaagtgctgtagacggacgcgcggcctgtttaaatatagacatctcaaggacgatgaagagacagggtaccggcgcatcattgaaaaactgaacaataagaaaggaaagaacaagctgcttgacggcgagagactggctgatggccggatcgccgagcttttctccaccaaaacccacattgggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17076 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (opt5)
  source 1..3934: mol_type = other RNA
ggggcgctgcctacggaggtggcagccatctccttctcggcatcaagcttaccatggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaagctgctgcaagtgtctgagtccacaggagtggctctcaaacggagctcctggctgatcgtcctgctcgtgctgttcacggtttctcttagccccgtgcagtccgcccctattggccaggggaagaccatcgaggcttatagagcccgcgaaggatacacaagcatttgtctgtttgtcctcggctctatcctgttcatcgtgtcctgccttatgaaagggctggttgatagcgtgggaaattctttctttcccggcctcagcatttgtaagacctgctccatctctagcattaacggctttgagatcgaatcccacaaatgttattgcagcctgttctgctgtccgtactgccggcattgttctacagacaaggagattcacaagctgcatctctccatctgcaaaaagagaaaaaccgggagcaatgtcatgctggcggtgtgtaaacttatgtgcttccgcgccacgatggaagtctctaaccgggctctgtttattagatccatcatcaatacaaccttcgtgctctgtattctgatcctggccgtttgcgtggtcagcacctccgctgtggagatggagaaccttcctgccggaacatgggaacgcgaggaagatctcaccaacttttgtcaccaggagtgccaagttacagaaacggagtgtctgtgcccctatgaggccctggtgctccggaagcctctgttccttgactctaccgctaagggcatgaagaatctgctcaacagcacatccctggaaacctctctgagcattgaggcgccctggggagccatcaatgtccagtccacatacaaacccaccgtgagcacggctaacattgccctttcttggtccagcgtggaacacagagggaataagatcctcgtttctggccgctccgagagcatcatgaaactggaggaacggaccgggatttcttgggatctgggcgtcgaggacgccagcgaatccaagctcctgacagtgagcgtgatggatctttctcagatgtattcccctgtctttgagtacctgagcggagacagacaagtggaagagtggccgaaagctacctgcacaggcgattgtcccgagcgctgcgggtgtacctcctctacgtgcctccataaggaatggcctcacagccggaactggagatgtaatcccacatggtgctggggagttggcaccgggtgtacatgctgtggactggacgtgaaggatctgttcaccgactacatgtttgtcaaatggaaggtggagtatatcaaaaccgaagccattgtttgcgtggagcttacatcccaggaacggcagtgttctctcatcgaggcgggcacgcgcttcaacctggggcctgtcaccattacactgagcgagcccagaaatatccagcaaaagctcccgcctgaaatcattaccctgcatccccggatcgaggaaggctttttcgaccttatgcacgtgcagaaagttctgtccgcttctacagtgtgcaagctccagagctgcacccatggagtccctggcgatcttcaggtgtaccacattgggaacctgcttaagggagacaaagtgaatggccacctcatccataagattgagccccactttaacacgtcctggatgagctgggatgggtgtgacctggattattactgcaatatgggagactggccttcttgtacatataccggcgtcacccaacataaccacgcctccttcgttaatctgctcaacatcgaaacagattacaccaaaaactttcacttccatagcaagagagtgacagcccacggggacacgccccagctggatcttaaagctcgcccgacctatggcgccggagagatcacagtgctggtcgaggtggctgacatggaactccataccaagaaaattgagatctctggcctgaagttcgcctccctggcgtgcacagggtgttacgcctgctctagctccattagctgtaaggttcggatccacgtggatgaacctgacgagcttaccgtccatgtgaaatccgatgaccccgacgttgtggctgccagctctagcctgatggctagaaagctcgagtttggaacggattccaccttcaaagccttttctgcgatgcccaagacaagcctgtgcttctacattgtcgaacgcgagcactgtaaatcctgctctgaagaggacaccaagaagtgtgtgaatacaaaactcgaacagcctcagagcatcctgattgagcacaagggcaccatcatcgggaaacaaaactccacatgcaccgccaaggcttcttgctggcttgagagcgttaaatcctttttctatggactgaagaatatgctcagcggcatttttgggaacgtgttcatgggcatctttctgttcctggccccgtttattcttctgatcctcttctttatgttcggatggcggattctgttctgttttaagtgctgtagacgcacgagaggcctcttcaaataccggcatctgaaggatgacgaagagacagggtatcgcagaatcatcgaaaaacttaataacaagaaaggaaagaataagctgctcgatggcgagcggctggctgacgggcgcattgccgaactgttttctaccaaaacccacatcggatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17077 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (opt5)
  source 1..3355: mol_type = other RNA
ggggcgctgcctacggaggtggcagccatctccttctcggcatcaagcttaccatggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaaacttctgcaagtgtctgagtccacaggagtggctctcaagcggagctcctggctgatcgtcctgctcgtgctgttcacggtttctcttagccccgtgcagtccgcccctattggcagaaagcccctgtttctcgatagcaccgctaaagggatgaagaatctgcttaactctacatccctggagaccagcctctctatcgaagccccgtggggagcgattaatgtccagagcacatataaacctaccgtgtccacggccaacatcgctctgtcttggagctccgttgagcaccgcggcaataagatcctggtgagcgggcggtctgaatccattatgaagctcgaggaaagaacaggaatcagctgggacctgggcgtcgaggatgcctctgagtccaaacttctgaccgtgagcgtcatggacctctcccagatgtactctcccgtgttcgaatatctgagcggcgatcgccaagttgaggaatggcctaaggctacctgtacaggggactgccccgagcggtgtggatgcacctcctctacatgtctgcataaagaatggccccacagcagaaactggcgctgcaaccctacgtggtgctggggcgtggggaccggatgtacatgctgtggccttgatgtcaaggacctctttaccgattacatgttcgtgaaatggaaggttgagtatattaagacagaggccatcgtgtgcgtcgaactgacctcccaggagcggcagtgtagcctgattgaagccgggacgagatttaatctcggcccggtgaccatcacactgtctgagccccgcaacattcaacagaaacttcctcccgagatcatcaccctgcatcctcggattgaagagggattcttcgacctcatgcacgtgcagaaggttctgtccgctagcacagtctgcaaactgcagtcttgtacccacggcgtgcccggggatcttcaagtgtaccatatcggaaatctcctgaagggcgacaaagtcaacgggcacctgattcataagatcgaaccgcactttaatacgtcctggatgagctgggacggatgcgatctcgactattactgtaacatgggcgattggccttcttgcacatacaccggggtgacacagcataatcacgcgagcttcgttaacctgcttaatattgagaccgactataccaagaactttcacttccattccaaaagagtgacagcccacggcgatacgccccagctggacctcaaggctcgccctacctacggagccggcgaaatcacagtcctggtggaggttgccgatatggagctgcataccaaaaagatcgaaattagcgggcttaaatttgcttctctcgcctgtacaggatgctatgcgtgctccagctccatctcttgtaaggtgcggattcacgtcgacgagcccgatgaactgaccgtgcacgttaagagcgacgatcctgacgtggtcgctgcctcctctagcctgatggccagaaaactcgagttcggcacggattccacatttaaggctttctctgccatgcccaaaaccagcctgtgcttttacatcgtggaacgggagcattgtaagtcctgcagcgaggaagacaccaaaaagtgtgtgaatacaaaacttgagcagccgcaatctattctgatcgaacacaaggggaccatcattggaaagcagaactccacatgcacggctaaagccagctgttggctcgagtctgtcaagtccttcttttatggcctgaaaaatatgctgagcgggatcttcggcaacgtttttatgggaattttccttttcctcgcgccttttatcctgctgattctcttctttatgttcggctggcgcatcctgttttgcttcaagtgttgcagacggaccagagggctttttaaataccgccatctgaaggacgatgaagagacaggatatcggagaatcattgagaagctcaataacaaaaagggcaaaaacaagctgctggacggggaacgccttgccgatggaagaatcgctgagctgttctctaccaaaacacacattggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17078 - RNA, 1411 nt, synthetic construct
  misc_feature 1..1411: note = mRNA product Design2 comprising derived and/or modified sequence from CCHVF(10200)__U39455.2__IgE-leader_Gn (opt5)
  source 1..1411: mol_type = other RNA
ggggcgctgcctacggaggtggcagccatctccttctcggcatcaagcttaccatggactggacctggatcctgttcctcgtggccgctgccacaagagtccacagctccgaggaaccctctgatgactgcgttagccggacgcagctgcttcgcaccgagacagcggaaattcatggcgataactacgggggacctggcgacaagatcaccatttgtaatgggtccacaatcgtggatcaaagactgggatctgagctcggctgctataccattaaccgggtgcgcagctttaaactgtgtgaaaattccgctacagggaagaactgcgagatcgactctgtcccggtgaaatgtagacagggatactgccttcggatcacccaggagggccgcggccacgttaagctgagcagagggtccgaagtggtcctcgatgcctgtgacacgagctgcgagattatgatccccaaaggaaccggcgatattctggtggactgttctgggggacagcaacatttcctgaaggataatctcatcgacctgggctgccctaagattccccttctggggaaaatggccatctatatttgtcggatgtccaaccaccctaagacaaccatggcttttctcttctggtttagcttcggatacgttatcacatgcatcctgtgcaaagccatcttttatcttctgattattgtgggcaccctcggccgcagactgaagcagtaccgggaactgaaaccccagacgtgtacaatctgcgagaccacacctgtcaatgctattgatgccgagatgcatgacctcaactgttcttataatatctgcccgtactgtgcgtcccgcctgaccagcgacgggcttgccagacacgtgatccagtgccccaagcggaaggaaaaagtggaggaaaccgagctgtacctcaacctggaacgcattccttgggtcgttagaaaacttctgcaagtgtctgagtccacaggagtggctctcaagcggagctcctggctgatcgtcctgctcgtgctgttcacggtttctcttagccccgtgcagtccgcccctattggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17079 - RNA, 2371 nt, synthetic construct
  misc_feature 1..2371: note = mRNA product Design2 comprising derived and/or modified sequence from CCHVF(10200)__U39455.2__IgE-leader_Gc (opt5)
  source 1..2371: mol_type = other RNA
ggggcgctgcctacggaggtggcagccatctccttctcggcatcaagcttaccatggactggacctggatcctgttcctcgtggccgctgccacaagagtccacagctttctggattccacggcgaagggcatgaaaaaccttctcaattctaccagcctggagacatccctgtctattgaagctccctggggagccatcaacgttcagagcacctacaagcctacagtgtccaccgccaatattgctctttcttggagctccgtggagcatcgggggaacaaaatcctggtcagcggccgctctgaatccattatgaagctcgaggaaagaacagggatcagctgggacctgggagtggaggatgcctctgagtccaaactgctcaccgttagcgtgatggacctgtctcaaatgtattccccggtcttcgaataccttagcggcgatcgccaggtggaggaatggcccaaggctacgtgcaccggggactgtcctgagcggtgcggatgtacatcctctacctgcctgcacaaggagtggccccatagcagaaattggcggtgtaaccctacatggtgctggggcgttggcaccgggtgtacgtgctgtggactcgatgtgaaagacctgtttacagattatatgttcgtcaagtggaaagtggaatacatcaagaccgaggccattgtgtgcgtcgaacttacatcccaggagcgccagtgtagcctgatcgaagcgggcaccagatttaatctcgggcccgttaccattacactgtctgagcctcggaacatccaacagaaactgccgcccgagattatcacgctccaccctcgcattgaagagggattctttgacctgatgcatgtgcagaaggtgctttccgccagcaccgtctgcaagctgcagtcttgcacacacggcgtgcccggggatctccaagtttatcacatcggaaatctgcttaaaggcgacaaggtgaacggccatctgatccacaaaattgaacctcatttcaataccagctggatgtcctgggatgggtgtgacctcgactactattgcaacatgggagattggccctcttgtacatacaccggcgtcacgcagcacaatcacgctagctttgtgaacctgctgaatatcgagacagactacaccaagaacttccattttcactccaaaagagttaccgcccatggggatacaccgcagctcgacctgaaggctcggcctacctatggagccggcgaaattacagtgcttgtcgaggtggcggatatggagctgcacacgaaaaagatcgaaattagcgggctcaagttcgcctctctggcttgcaccggatgttacgcctgctccagctctatctcctgtaaagtccgcatccatgtggacgagcccgatgaacttacagttcacgtgaagtccgacgatcctgacgtcgtggctgcctcctctagcctgatggccagaaaactcgagtttggcaccgattccacattcaaggctttctctgcgatgcccaaaaccagcctgtgcttttatattgttgaacgggagcactgtaagtcctgcagcgaggaagacacgaagaaatgtgtgaacaccaagctggagcagccccaatctatcctcattgaacataaaggcacaatcattgggaagcagaatagcacatgcaccgccaaagctagctgctggctggagtctgtcaagtccttcttttacggacttaagaacatgctgagcggcatcttcgggaatgtgtttatgggaatcttcctctttctggcccctttcattctgcttatcctctttttcatgtttggctggcgcattctgttctgttttaaatgctgtagacggaccagagggctgttcaagtatcgccacctcaaagacgatgaggaaacgggctaccggagaatcattgagaagctgaacaataaaaagggaaagaacaaacttctggacggcgaacgcctcgccgatgggcggatcgctgagctgttctctacaaagacccatattggatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17080 - RNA, 1831 nt, synthetic construct
  misc_feature 1..1831: note = mRNA product Design2 comprising derived and/or modified sequence from CCHFV(10200)__NC_005302.1/U88410.1__N (opt11)
  source 1..1831: mol_type = other RNA
ggggcgctgcctacggaggtggcagccatctccttctcggcatcaagcttaccatggaaaacaaaatcgaggtgaacaacaaagacgaaatgaaccgatggttcgaagagttcaagaaaggcaacggacttgtagacacgttcaccaactcctactccttctgcgaatcagtccccaacctagaccgattcgtcttccaaatggccagcgcaacagacgacgcacaaaaagactcgatatacgcatccgccctagtagaagcaaccaaattctgcgcccccatctacgaatgcgcttgggtatctagcacaggaatcgtcaagaaaggactcgaatggttcgagaaaaacgccggcacaatcaaatcctgggacgaatcatacaccgaactaaaagtagacgtacccaaaatagaacaactcaccggctaccaacaagccgcactaaaatggcggaaagacatcggcttccgcgtcaacgccaacaccgccgccctctccaacaaagtcctagccgaatacaaagtccccggcgaaatcgtcatgtccgtcaaagaaatgctctccgacatgatcagacggcgcaacctcatccttaaccgcgggggagacgaaaatccccgcggacccgtctctcacgaacacgtcgactggtgccgcgagttcgtcaaaggcaaatacataatggcgttcaacccaccctggggagacataaacaaatcaggccggtcaggcatcgccctcgtcgccaccggactagccaaactcgcagaaacggaaggcaagggcatattcgacgaagctaagaaaaccgtcgaggcacttaacggatacctagacaaacacaaagacgaggtcgaccgagccagcgcagacagcatgataaccaacctactgaaacacatcgcaaaagcgcaagaactatacaaaaactcctcagccctccgagcccaaagcgcacaaatcgacacagcattctccagttactactggctctacaaagcaggagtcacccccgaaacattccccacagtcagccaattcctcttcgaactaggaaaacaaccccgaggcacaaagaaaatgaagaaagcgttactcagcacccccatgaaatggggcaagaaactatacgaactcttcgccgacgactccttccaacaaaaccgcatatacatgcacccggccgtacttaccgcaggacgcatatcagagatgggcgtctgcttcggtaccatccccgtggccaacccagacgacgcagcacaaggatctggccacaccaaaagcatcctcaacctccgcacaaacaccgaaaccaacaacccatgcgcaaaaacaatagtcaaactattcgaagtccaaaagaccggcttcaacatccaagacatggacatcgtcgcatctgaacacctactccaccaaagcctggtcggaaaacaatcccccttccaaaacgcctacaatgtcaaaggcaacgcaacctccgccaacatcatctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17081 - RNA, 1831 nt, synthetic construct
  misc_feature 1..1831: note = mRNA product Design2 comprising derived and/or modified sequence from CCHFV(Turkey-Kelkit06)__GQ337053.1__N (opt11)
  source 1..1831: mol_type = other RNA
ggggcgctgcctacggaggtggcagccatctccttctcggcatcaagcttaccatggaaaacaaaatagaagtcaactccaaagacgaaatgaacaaatggttcgaagaatttaaaaaaggcaacggcctaatggacacattcaccaactcttactccttctgcgaaaacgtccccaacctcgacaaattcgtcttccaaatggcctccgccaccgacgacgcccaaaaagactcaatctacgcctccgccctagtcgaagccacgaaattctgcgccccaatctacgaatgcgcctgggtaagctccaccggcatagtgaaaaagggcttagaatggttcgagaaagactccggaaccataaaatcatgggacgaaaactacgcagaactcaaagtagacgtacccaaaatcgagcaactcgccaactatcagcaagcagccctaaaatggcgcaaagacataggtttccgcgtaaacgccaacaccgccgccctctcaaacaaagtcctcgccgaatacaaagtcccgggagaaatcgtgatgtcagtcaaagaaatgctaagcgacatgatccgccgccgcaatctaatcctcaaccgcggtggagacgaaaacccccgagggcccgtcagccgagaacacgtcgaatggtgcagagaatttgtaaaaggcaaatacattatggcatttaacccaccatggggcgacatcaacaagtcaggacgaagtggaatcgcactcgtcgccacaggcctcgccaaactcgcagaaaccgaaggaaaaggcgtcttcgacgaagcaaaaaaaaccgtcgaggcccttaacggatacctcgacaaacaccgcgacgaagtcgacaaagcctccgcggactccatgataacaaacctcccaaaacacatcgcgaaagcccaagaactctacaaaaactcctcagcactcagagcccaaggagcccaaattgacaccccgttctccagcttctactggctttacaaagcaggcgtcacccccgaaacattccccaccatcagccagttcctattcgaactcggagaacaaccaagaggaacaaaaaaaatgaaaaaggccctcctctccacacccatgaaatggggaaaaaaactgtacgaactcttcgccgatgactcattccaacaaaaccgcatctacatgcaccctgccgtcctcaccgccggccgcataagcgaaatgggggtctgcttcggcaccatacccgtcgccaatccagacgatgcagcccaaggctccggacataccaaaagcatcctgaacctccgaaccagcacagaaaccaacaacccctgcgccaagacaatcgtcaagctatttgaaatccaagaaaccggcttcaacatacaggacatggacatcgtcgcctcggaacacctcctccaccaatccatcgtcggaaaacaaagtcccttccagaacgcatacaacgtcaaaggcaacgccacatccgccaacatcatctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17082 - RNA, 5437 nt, synthetic construct
  misc_feature 1..5437: note = mRNA product Design2 comprising derived and/or modified sequence from CCHFV(10200)__U39455.2__GP (opt11)
  source 1..5437: mol_type = other RNA
ggggcgctgcctacggaggtggcagccatctccttctcggcatcaagcttaccatgcacatcagcctgatgtacgccatcttatgcctacagctgtgcggcctcggggaaacccacggctcccacaacgagacccgccacaacaagacggacaccatgaccacccacggggacaaccccagctccgagccgcccgtgagcacggccctgtccatcaccctggaccccagcaccgtcacccccacgaccccggcgtccggcctcgaggggagcggcgaggtgtacacctccccgcccatcaccacgggcagcctgcccctgtccgagaccacccccgagctccccgtgaccacggggaccgacaccctgagcgccggcgatgtcgacccctccacccagacggccgggggcaccagcgcccccaccgtgcggacgtccctgccgaacagcccctcgacgcccagcacgccccaggacacccaccacccggtgcgcaacctcctgtccgtcaccagccccgggcccgacgagaccagcaccccgtccggcaccggcaaggagagctccgccaccagctccccgcacccagtgagcaaccggcctcccacgccacccgcgaccgcccaggggcccaccgagaacgactcccacaacgccaccgagcaccccgagagcctgacgcagtccgccacccccggcctcatgaccagccccacccagatcgtgcacccccagtccgcgaccccgatcacggtccaggacacccaccccagccccaccaaccgctccaagcggaacctgaagatggagatcatcctgaccctcagccaggggctgaagaagtactacggcaagatcctgcgcctcctgcagctaacgctcgaggaggacacggagggcctgctcgaatggtgcaagcggaacctcgggctggactgcgacgacaccttcttccagaagcggatcgaggagttcttcatcaccggcgaggggcacttcaacgaggtgctgcagttccggacgcccggcaccctctccactaccgagagcacgccggccgggctgcccaccgccgagcccttcaaatcctacttcgccaagggtttcctgagcatcgactccggctactacagcgccaagtgctacagcgggacctccaacagcggcctccagctgatcaacatcacccgccactccactcggatcgtagacacccccgggccgaagatcacgaacctgaagaccatcaactgcatcaacctcaaggcgagcatcttcaaggagcaccgagaggtggagatcaacgtgctgctgccccaggtggccgtcaacctctccaactgccacgtggtgatcaagagccacgtgtgcgactactccctggacatcgacggcgccgtgcggctgccccacatctaccacgagggggtgttcatccccggcacgtacaagatcgtcatcgacaagaagaacaagctcaacgaccgctgtacccttttcaccgactgcgtgatcaagggacgggaggtgcgcaagggccagagcgtcctgcggcagtacaagactgagatccgcatcggcaaggcctccaccgggttccggcgcctcctgagcgaggaaccgtccgacgactgcgtgagccggacccagctgttacgcacagagaccgccgagatccacggcgacaactacgggggccccggcgacaagatcacgatctgcaacgggtccaccatcgtcgaccagcgcctgggcagtgaactggggtgctacaccatcaaccgggtgcgctccttcaaactgtgcgagaacagcgcgaccggcaagaactgcgagatcgactccgtgcccgtcaagtgccggcagggctactgcctccgcatcacgcaggaggggcgtggccacgtgaagctgagccgcgggagcgaggtggtcctggacgcctgcgacacctcctgcgagataatgatccccaagggcaccggggacatcctagtggactgcagcgggggccagcagcacttcctgaaggacaacctgatcgacctcgggtgcccgaagatccccctgctgggcaagatggccatctacatttgccggatgtccaaccaccccaagaccacgatggccttcctcttctggttcagcttcgggtacgtgatcacgtgcatcctgtgcaaggctatcttctacctgctcatcatcgtcggcaccctggggcgccggctgaagcagtaccgtgagctcaagccccaaacctgcaccatctgcgagaccaccccggtaaacgcgatcgacgccgagatgcacgacctgaattgctcctacaacatctgcccctactgcgcctcccggctgacctccgacggcctcgcccgccacgtgatccagtgccccaagcggaaggagaaggtcgaggagaccgagctgtacctgaacctcgagcgcatcccctgggtggtgcggaagctgctgcaggtcagcgagtccacgggcgtggccctcaagcgcagctcctggctgatcgtgctgctcgtcctgtttaccgtgagcctgtccccggtgcagagcgcgcccatcgggcagggcaagaccatcgaggcctaccgggcccgcgaggggtacacctccatctgcctcttcgtcctgggcagcatcctgttcatcgtgtcctgcctcatgaagggtctggtggacagcgtcggtaactccttcttccccggcctgagcatctgcaagacgtgcagcatctccagcatcaacgggttcgagatcgagtcccacaagtgctactgcagcctcttctgctgcccgtactgtcggcactgctccaccgacaaggagatccacaaactgcacctgagcatctgcaagaagcgcaagaccggctccaacgtgatgctcgctgtgtgcaaactgatgtgcttccgcgcgaccatggaggtaagcaaccgggccctgttcatccgctccatcatcaacacgaccttcgtgctctgcatccttatcctggccgtgtgcgtcgtgagcacctccgccgttgagatggagaacctccccgccgggacctgggagcgggaggaggacctgacgaacttctgccaccaggagtgccaagtcaccgagaccgagtgcctgtgcccctacgaggcgctcgtgctgcgcaagcccctgttcctcgacagcaccgccaagggcatgaagaacctgctgaactccacgagcctcgagacctccctgagcatcgaggccccgtggggcgccatcaacgtgcagtccacctacaagcccaccgtcagcacggccaacatcgcgctgtcatggagcagcgtggagcaccggggaaacaaaatcctcgtgtccggccgcagcgagtccatcatgaagctggaggagcggaccggtatcagctgggaccttggagtcgaggacgcctccgagagcaagctcctgaccgtgtccgtgatggacctaagccaaatgtactcccccgtcttcgagtacctcagcggggaccgccaggtggaagaatggcccaaggcgacctgcacgggcgactgcccggagcggtgcggctgcacctccagcacgtgcctgcacaaggagtggccccactcccgcaactggaggtgcaaccccacctggtgctggggcgtggggaccgggtgcacgtgctgcggcctggacgtcaaggacctcttcaccgactacatgttcgtgaagtggaaggtggagtacatcaagaccgaggccatcgtctgcgtggagctgaccagccaggagcgccaatgctccctgatcgaggccgggacccggttcaacctcggccccgtgaccatcaccctgagcgagccgcgcaacatccagcagaagctgccgcccgagatcatcaccctccacccccggatcgaggagggcttcttcgacctgatgcacgtccagaaggtgctgtccgccagcacggtgtgcaagctccagtcctgcacccacggggtgcccggcgacctccaggtgtaccacatcgggaacctgctgaagggcgacaaggtcaacgggcacctgatccacaagattgagccccacttcaacactagctggatgagctgggacggctgcgatctggactactattgcaacatgggcgactggccctcctgcacctacacaggggtgacccagcacaaccacgccagcttcgtgaacctcctgaacatcgagaccgactacaccaagaacttccacttccactccaagcgcgtcacggcccacggcgacacgccccagcttgacctcaaggcccggccgacctacggggcgggcgagatcaccgtgctggtggaggtagccgacatggagctgcacaccaagaagatcgagatcagcgggctcaagttcgcctccctggcctgtaccggctgctacgcctgcagctccagcatctcctgcaaagtgcgcatccacgtggacgagcccgacgagctaaccgtccacgtcaagagcgacgaccccgatgtggtggcggcctcgtcttccttaatggcccggaagctggagttcggcaccgactcgacgttcaaggccttctccgccatgcccaagaccagcctgtgcttctacatcgtggagcgcgagcactgcaagtcctgcagcgaggaagacaccaagaaatgcgtgaacaccaagctcgagcagccgcaatccatcctgatcgagcacaaggggacgatcatcggcaagcagaactccacgtgcaccgcgaaagccagctgctggctggaaagcgtcaagagcttcttctacgggctgaagaacatgctctccggcattttcggcaacgtgttcatggggatctttctgttcctggcccccttcatcctcctgatcctgttcttcatgttcggctggcggatcctcttctgcttcaagtgctgccgccgcacccgggggctgttcaagtaccgccacctgaaagacgacgaggagaccggctaccggcgcattatcgaaaagctcaacaacaagaaggggaagaacaagctgctggacggtgagcggctcgccgacggccgcattgccgagctgttcagcaccaagacccacatcgggtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17083 - RNA, 5437 nt, synthetic construct
  misc_feature 1..5437: note = mRNA product Design2 comprising derived and/or modified sequence from CCHFV(IbAr10200)__AF467768.2__GP (opt11)
  source 1..5437: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagacccgccataacaaaaccgacaccatgacgacgcccggggacaacccgagctccgagccgcccgtcagcaccgccctgtcgatcaccctggaccccagcactgtcacgccgacgacccccgcgtccggcctcgaggggagcggagaggtatacacctcaccgcccataaccacgggcagcctgcccctgtccgagaccacccccgagctccccgtgaccacgggaaccgacaccctcagcgccggcgacgtcgacccctccacccagacggccgggggcaccagcgccccgaccgtgcggaccagcctgcctaactctccctccacgcccagcacgccgcaggacacccaccaccccgtgcgcaacctcctgtccgtcaccagccccgggcccgacgagacgagcaccccgtccggcaccgggaaggaaagctccgccacaagcagcccccaccccgtgagcaaccggcccccgaccccgcccgcgaccgcccagggtcccacagagaacgactcccacaacgccaccgagcacccggagagcctgactcagtccgccacccccggcctcatgaccagccccacccagatcgtgcacccgcagtccgcgacccccatcacggtccaggatactcaccccagtcccacgaaccgctccaagcgaaacctgaagatggagatcatcctgaccctcagccaggggctgaagaagtactacggcaagatcctgcgcctcctgcagctgacgctagaggaggacaccgagggtctgctggagtggtgcaagcggaacctcgggctggactgcgatgacaccttcttccagaagcgcatcgaggagttcttcatcaccggcgaggggcacttcaacgaggtgctgcagttccgaacgccgggaaccctctccaccacagagagcacgcccgccgggctgcccacggccgagcccttcaagtcctacttcgccaagggcttcctgagcatcgactccggttactacagcgccaagtgctacagcgggacgtccaacagcggcctccagcttatcaacatcacccgccactccacgcggatcgtcgacaccccggggcccaagatcaccaacctgaagaccatcaactgcataaacctcaaggcgagcatcttcaaggagcaccgcgaggtcgagatcaacgtgctgctgccccaggtggccgtaaacctctccaactgccacgtagtgataaagtcacacgtctgtgactacagtctggacatcgacggcgccgtgcggctgccccacatctaccacgagggggtgttcatccctggcacgtacaagatcgtcatcgacaagaagaacaaactcaacgaccgctgcaccttattcacagactgcgtgataaagggccgggaggttcgcaaggggcaaagcgtcctgcggcagtacaagaccgagatccgcatcgggaaggcctccacggggagccggcggctcctgtccgaggagcccagcgacgactgcatttcccggacccagctgctccgcaccgaaaccgccgagatccacggcgacaactacgggggccccggcgacaagatcacgatttgcaacggcagcaccatcgtggaccagcgcctgggctccgagctagggtgctacacgatcaaccgtgtccgcagcttcaagctgtgcgagaactcggctaccggcaagaactgcgagattgactcagtgcccgtgaagtgccggcagggctactgcctccgtatcactcaggaggggcggggccacgtgaagctgagccgcgggtccgaggtggtgctcgacgcctgcgacaccagctgcgagatcatgatccctaagggcaccggggacatcctcgtcgactgctccggcggccagcagcacttcctcaaggacaacctgatcgatctcgggtgtcctaagatccccctgctgggcaagatggccatctacatctgccggatgagcaaccaccccaagaccacgatggcattcctcttctggttctccttcgggtatgtgatcacctgtatcctctgcaaggctatcttctacctccttatcatcgttggcaccctggggaagcgcctgaagcagtaccgggagctcaagccgcagacctgcaccatctgcgagacgacccccgtcaacgcgatcgacgccgagatgcacgacctgaactgcagctacaacatctgcccctactgcgcctcccgtctgaccagcgacgggctcgcccggcacgtgattcagtgccccaagcgcaaagaaaaggtggaggagaccgagctgtacttaaacctcgaacggatcccgtgggtcgtgcgcaagctgctgcaggtatccgagagcacgggcgtcgccctcaagcggtccagctggctgatcgtactgctcgtgctgttcaccgtctccctgagccccgtacagtccgcgcccatcgggcagggcaagaccatagaagcgtaccgcgcccgggaggggtacacttctatttgcctcttcgtgctgggctccatcctgttcatcgtcagttgtctcatgaaggggctcgtggactcagtgggcaacagcttcttcccgggcctgagcatctgcaagacgtgctcgatcagctccatcaatgggttcgagatcgagagccacaagtgctactgctccctcttctgctgcccctactgccgccactgcagcaccgacaaggagatccacaagctgcacctgtctatatgcaagaagcggaagaagggcagcaacgtcatgttagccgtttgcaagctgatgtgcttccgcgcgaccatggaggtgtccaaccgcgccctgttcatccggagcatcatcaacactacgttcgtcctctgcatactgatactggccgtgtgtgtggtctccaccagcgccgtggagatggagaacctccccgccgggacctgggagcgcgaggaagacctgaccaacttttgccaccaagagtgccaagtgacggagaccgagtgcctgtgcccctacgaggcgctcgtcctgcggaagccgctgttcctcgactccaccgccaagggcatgaagaacctgctgaacagcacatccctcgagacaagcctgtccatcgaggccccctggggcgccatcaacgttcagagcacatacaagccgaccgtgtccaccgctaacattgcactgagctggagctccgtcgagcaccgcgggaacaagatcctcgtgagcggccgatccgagagcatcatgaagctggaggagcgcacggggatctcctgggacctgggcgtggaggacgccagcgagtccaagctcctgaccgtcagcgtcatggacctgtctcagatgtacagcccggtgttcgagtacctcagtggggaccggcaggtcggagagtggccgaaggcaacctgcaccggcgactgccccgagcgctgcgggtgcacgagctcgacttgcctgcacaaggagtggccccatagccggaactggcgctgcaaccccacctggtgctggggcgtggggaccggctgcacgtgctgcgggctggacgtcaaagacctctttaccgactacatgttcgtaaagtggaaggtggagtatatcaagaccgaggccatcgtgtgcgtcgagctgaccagtcaggaacggcagtgtagcctgatcgaggccggcacgcgattcaacctcggcccggtgaccataaccctgtccgagccccggaacatccagcagaagctgcccccggagatcatcaccctccacccgcgcatcgaagaagggttcttcgacctgatgcacgtccagaaggtactgagcgccagtacagtgtgcaagctccagtcctgcacgcatggcgtcccaggggacctccaggtgtaccacatcggcaatctgctgaaaggggataaggtgaacggccacctgatccacaaaatagagccccacttcaacaccagctggatgtcctgggacggctgtgacctggactactactgcaacatgggggactggcccagctgcacctacaccggcgtcacgcagcacaaccacgcctccttcgtcaacctcctgaacatcgagaccgactacaccaagaacttccacttccacagcaagcgtgtgaccgcccacggggacacgccgcagttagacctcaaagcccgccccacgtacggcgcgggggagatcaccgtactggttgaggtggccgatatggagctgcacactaagaagattgaaatctccggcctcaagttcgcctcgctggcctgcacgggctgctacgcctgctcctcagggatctcctgcaaggtccggatccacgtagacgagcccgacgagctgacagtgcacgtcaagagcgacgaccccgacgtggtggcggcctccagctccctcatggcccgcaagctggagttcggcaccgacagcacctttaaggccttctccgccatgccgaagacgagcctgtgcttctacatcgtcgagcgggagcactgcaaatcctgcagcgaggaggacaccaagaagtgcgtgaacaccaaactcgagcagccccagtccatcctgatcgagcacaaggggaccatcataggcaaacagaacagcacgtgcaccgcgaaggccagctgctggctggagtccgtgaagtccttcttctacggcctgaagaacatgttatccgggatcttcggcaacgtcttcatggggatcttcttgttcctggcacccttcattctccttatcctgttcttcatgttcggctggcgcatcctcttctgcttcaagtgctgccgccgcacccgcgggctgttcaagtaccggcacctgaaggacgacgaggagaccggatatcgccggatcatcgagaagctcaacaacaagaagggcaagaacaagctgctggatggcgagcgcctcgccgaccggcgcatcgccgaactgttcagcacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17084 - RNA, 5449 nt, synthetic construct
  misc_feature 1..5449: note = mRNA product Design2 comprising derived and/or modified sequence from CCHFV(Turkey-Kelkit06)__GQ337054.1__GP (opt11)
  source 1..5449: mol_type = other RNA
ggggcgctgcctacggaggtggcagccatctccttctcggcatcaagcttaccatgcccaccaacattatgcacaccccgctggtgtgcttcatcctctacctgcagctgttatgcctgggcggggcccacggccaactgaacgccacggagcacaacgggaccaacaacacaacggcgcccggcgccagccagtcccccaaacccccgatgagcactacaccaccccacgcccccgagtccagcaccatcaagccgaccacgccaatttccgaggccgaggggagcggagagaccacctccccgcccaataccacgcagggcctcagttcccccgagaccaccagcgagcgccctgccaccacgtccatcagcacttccagcaccgactccaccaaccccacgacgcagatgaccgacaacacccccactccgaccgtctcgacctcccccagctccagccccagcaccccctccactccgcaggggatccaccacccagcgcggagcctgctgtccgtttcttcccccaagaccgtgaccacccccacgccgaccagccccggtgagatgtccagcgagacctccagccagcacagcgccatgagccgcatccccactccccacaccgcgacccgggtatccaccgagatcaccaaccaccgcaccccgcggcagagcgagtcaagcgcccagcagacgacgccttcccccatgaccagcccggcgcagtccatcctcctgatgagcgccgcacccaccgccgtgcaggacatccaccccagcccaacgaaccgctccaagcggaacctggaaaccgagatcatcctcaccctcagccaggggctgaagaagtactatggcaagattctcaagctcctgcacctcaccctggagcaagacacggaggggctgctcgaatggtgcaagggcaacctgggctccaactgcgacgacgacttcttccagaagaggatcgaggagttcttcatgaccggggagtgctacttcaacgaggtgctgcagttcaagaccctcagcaccctgtccccgaccgagcccagccatgcccggctgcccaccgcggagcccttcaagtcctacttcgccaaggggttcctgagcatcgactccgggtatttcagcgccaaatgctacccgcgctccagcgcctcaggcctgcagctgatcaacgtcacccagcaccccgcccggatcgctgagacccccggccccaaaacgactagcctcaagaccatcaactgcatcaatctgcgcgcctccgtgttcaaggagcacagagaggtggaaatcaacgtgctgctcccgcagatagccgtgaacctgagcaactgccacgtggtcatcaactcccacgtgtgcgactacagcctggacaccgacgggcccgtgcgtctcccccgcatctaccacgagggcacgttcatccccgggacatacaagatcgtcatcgacaagaagaacaagctgaacgaccgctgcacgctggtgacgaactgcgtgatcaagggccgggaggtccgcaaagggcagagcgtgttgcgtcagtacaagaccgagatcaagatcggcaaggcctccaccgggttccgcaagctgctgagcgaggaaccgggggacgactgcatctcccggacccaactcttgcgcaccgagacggctgagatccacgacgacaactacggcgggcccggcgacaaaatcaccatctgcaacggctcaactattgtggaccagagactgggctccgagttaggctgctacaccatcaaccgggtcaagagctttaagctgtgcaagaactccgcgacggggaagacctgcgaggtcgacagcacccccgtgaagtgccgtcagggcttctgtctcaagattacccaggaggggcggggccacgtgaagctgtcccgcgggtcagaggtggtactggacgcctgcgactccagctgcgaggtgatgatccccaagggcacgggcgacattctagtggactgcagtgggggtcaacaacactttctaaaagacaacctcatcgacctggggtgcccgcacatccccctgctcggccggatggccatctatatctgccgcatgagcaaccacccccggaccactatggccttcttgttttggttctcctttggctacgtgattacctgcatcttctgcaaggccctgttctattcgctcatcatcatcggaaccctgggtaagaagatcaagcagtaccgcgagctgaagccccagacgtgcaccatctgcgagaccgcgccggtgaacgccatcgacgccgagatgcacgacctcaactgctcctacaacatctgcccctactgcgcgagcaggctgacctccgacggactggcgcgccacgtgacgcaatgccccaagcggaaggagaaggtcgaggagaccgagctctacctgaacctggagcgcatcccgtggatcgtgcggaagctcttacaggtgagcgagagcaccggcgtcgccctgaagcgctccagctggctgatcgtgctgctggtactcctgaccgtctccctgagccccgtgcagtccgcccccgtcgggcacggcaagacgatcgagatctaccagacccgggagggcttcgctagcatctgcctcttcatgctggggtccatcctattcatcgtcagctgcctcgtgaagggcctggtggactccgttagcgagtccttcttccccgggctgtcggtgtgcaagacatgctccatcggcagcgtgaacgggttcgagatcgagtcccacaagtgctactgcagcctcttctgttgcccgtactgccgtcactgcagtgccgaccgggagatccaccagcttcatctgagcatctgcaagaagcgcaagaccggctccaacgtcatgctcgctgtgtgcaagcggatgtgcttccgcgccacgatcgaggcaagccgtcgggctctgctgatacgcagcataatcaacaccaccttcgtgatctgcatcctcaccctgacgatctgcgtcgtgtccaccagcgccgtggagatggagaacctgcccgccggcacctgggagcgggaagaggacctcaccaacttctgccaccaggagtgccaggtcacggagaccgagtgcctgtgcccctatgaagccctggtgctccgcaagcccctgtttctggactccatcgtgaaggggatgaaaaacctcctgaacagcacctccctggagaccagcctgtccatcgaggccccgtggggcgccatcaacgtgcagagcacattcaagcccaccgtgtccactgccaacatcgcgctgagctggtctagcgtggtccaccgggggaacaagatcctggttaccggccgctccgagagcatcatgaagctcgaggagcggacgggggtatcctgggacctgggcgtagaggacgccagcgagtcgaagctgctcaccgtgagcatcatggacctgtcccagatgtacagccccgtgttcgagtatctgagcggcgaccgccaggtagaggagtggcccaaggctacctgcaccggtgactgcccggagcggtgcggctgcacgtcgagcacctgtctccacaaggaatggtcccacagccgcaactggcggtgcaaccccacctggtgctggggcgtggggaccggatgcacgtgctgcggcgtggacgtcaaggacctatttaccgaccacatgttcgtgaagtggaaggtggaatacatcaaaaccgaagccatcgtttgcgtggcgctgacctcccaggagcgccagtgcagcctcatcgaggccggaacccggtttaacctagggccggtgacgattaccctctccgagccccgcaacatccagcagaaactcccgcccgagattatcaccctgcaccccaaaatcgaggagggctttttcgatctgatgcacgtccagaaggtgctcagcgcctccaccgtgtgcaagctgcagagctgcacgcacgggatccccggcgacctgcaggtctaccatatcggcaacctcctgaagggggaccgcgtgaacggccacctgatccacaagatcgagtcccacttcaacaccagctggatgtcctgggacgggtgtgacctcgactactactgcaacatgggcgactggccgagctgcacctacaccggggtcactcagcacaaccacgccgccttcgtgaacctgctgaacatcgagaccgactacaccaagaccttccactttcactccaagcgcgtaacggcgcatggcgacacccctcagctcgacctgaaggcccggcccacctacggcgccgggggcatcaccgtcctggtcgaggtggctgacatggagctccacactaagaaggtcgaaatcagcggactgaagttcgcctccctcgcgtgcaccggctgctacgcctgcagcagtgggatcagctgcaaggtacgcatccacgtggacgagccggacgagctcactgtccacgtaaagagcagcgacccggacgtggttgccgcgtcgacctcactgatggcccggaaactggagttcggcacggactcaacgtttaaggcgttctccgccatgcccaagaccagcctctgcttctacatcgtggagcgcgagtactgcaagtcctgcagcgaggacgacacccagaagtgtgtggacacgcggctggagcaaccccagtccatactgatcgagcacaaaggcacaatcatcgggaagcagaacgatacctgcaccgccaaggccagctgctggctcgagtccgtcaagagtttcttctacggcctgaagaacatgctggggtccgtgttcggcaacctattcatcgggatcctcctgttcctcgcgcccttcgtgttactcgtcctgtttttcatgttcggctggaagatcctcttctgcttcaagtgttgccgccgcacgcggggcctgttcaagtaccgccacctgaaggacgacgaggagaccgggtaccggagaatcatcgagcgactcaatagcaagaagggcaagaaccgcctgctggacggggaccgactcgccgaccgcaagatagccgagctattctccaccaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17085 - RNA, 3961 nt, synthetic construct
  misc_feature 1..3961: note = mRNA product Design2 comprising derived and/or modified sequence from CCHVF(10200)__U39455.2__SP-GP_Gn-NSm-Gc (opt11)
  source 1..3961: mol_type = other RNA
ggggcgctgcctacggaggtggcagccatctccttctcggcatcaagcttaccatgcacatcagcctgatgtacgccatcctctgcctgcagctgtgcggcctcggggagacccacggctcccacaacgagaccagcgaggagccctccgacgactgcgtgagccgcacgcagctgctgcggaccgagaccgccgagatccacggggacaactacggcgggccgggcgacaagatcaccatctgcaacggctccacgatcgtcgaccagcgcctcgggagcgagctgggctgctacaccatcaaccgggtgcgctccttcaagctgtgcgagaacagcgcgaccgggaagaactgcgagatcgactccgtgcccgtcaagtgccggcagggctactgcctccgcatcacccaggaggggcggggccacgtgaagctgagccgcggctccgaggtggtcctggacgcctgcgacacgagctgcgagatcatgatccccaaggggaccggcgacatcctcgtggactgctccgggggccagcagcacttcctgaaggacaacctgatcgacctcggctgccccaagatcccgctgctggggaagatggccatctacatctgccggatgagcaaccaccccaagaccaccatggccttcctcttctggttctccttcggctacgtgatcacgtgcatcctgtgcaaggccatcttctacctgctcatcatcgtcgggaccctgggccgccggctgaagcagtaccgcgagctcaagccccagacctgcaccatctgcgagacgacccccgtgaacgcgatcgacgccgagatgcacgacctgaactgcagctacaacatctgcccgtactgcgcctcccggctgaccagcgacgggctcgcccgccacgtgatccagtgccccaagcggaaggagaaggtcgaggagaccgagctgtacctgaacctcgagcgcatcccctgggtggtgcggaagctgctgcaggtctccgagagcacgggcgtggcgctcaagcgcagctcctggctgatcgtgctgctcgtcctgttcaccgtgagcctgtcccccgtgcagagcgccccgatcggccaggggaagaccatcgaggcctaccgggcccgcgagggctacacctccatctgcctcttcgtcctggggagcatcctgttcatcgtgtcctgcctcatgaagggcctggtggacagcgtcgggaactccttcttccccggcctgagcatctgcaagacgtgctccatcagctccatcaacggcttcgagatcgagagccacaagtgctactgctccctcttctgctgcccctactgccggcactgcagcaccgacaaggagatccacaagctgcacctgtccatctgcaagaagcgcaagaccgggagcaacgtgatgctcgccgtctgcaagctgatgtgcttccgcgcgaccatggaggtgtccaaccgggccctgttcatccgcagcatcatcaacacgaccttcgtgctgtgcatcctcatcctggccgtctgcgtggtgagcacctccgccgtcgagatggagaacctgcccgccggcacctgggagcgggaggaggacctcacgaacttctgccaccaggagtgccaggtgaccgagaccgagtgcctgtgcccgtacgaggcgctggtgctccgcaagcccctgttcctggacagcaccgccaaggggatgaagaacctcctgaactccacgagcctggagacctccctcagcatcgaggccccctggggcgccatcaacgtccagtccacctacaagcccaccgtgagcaccgccaacatcgcgctgtcctggagctccgtggagcaccgggggaacaagatcctggtcagcggccgctccgagagcatcatgaagctcgaggagcggacgggcatctcctgggacctgggggtggaggacgccagcgagtccaagctgctcaccgtgagcgtcatggacctgagccagatgtactccccggtgttcgagtacctgagcggcgaccgccaggtggaggagtggcccaaggccacctgtaccggggactgccccgagcggtgcggctgcacgtccagcacatgcctccacaaggagtggccccactcccgcaactggcggtgcaacccgacctggtgctggggcgtcgggaccggctgcacgtgctgcgggctggacgtgaaggacctgttcaccgactacatgttcgtgaagtggaaggtcgagtacatcaagaccgaggccatcgtgtgcgtggagctcaccagccaggagcgccagtgctccctgatcgaggccggcacgcggttcaacctggggcccgtcaccatcaccctcagcgagccccgcaacatccagcagaagctgcccccggagatcatcaccctgcacccccggatcgaggagggcttcttcgacctcatgcacgtgcagaaggtgctgtccgcgagcacggtctgcaagctgcagtcctgcacccacggcgtgcccggggacctccaggtgtaccacatcggcaacctgctgaagggggacaaggtcaacggccacctcatccacaagatcgagccgcacttcaacaccagctggatgtcctgggacgggtgcgacctggactactactgcaacatgggcgactggcccagctgcacctacacgggcgtgacccagcacaaccacgcctccttcgtgaacctgctcaacatcgagaccgactacaccaagaacttccacttccacagcaagcgcgtcacggcccacggggacaccccccagctggacctgaaggcccggcccacctacggcgcgggggagatcaccgtgctcgtggaggtcgccgacatggagctgcacacgaagaagatcgagatctccggcctgaagttcgccagcctcgcctgcaccgggtgctacgcctgctccagcagcatctcctgcaaggtgcgcatccacgtggacgagccggacgagctgaccgtccacgtgaagagtgacgaccccgacgtggtcgcggcctccagctccctgatggcccggaagctcgagttcggcaccgacagcacgttcaaggccttctccgccatgcccaagaccagcctgtgcttctacatcgtggagcgcgagcactgcaagtcctgcagcgaggaggacaccaagaagtgcgtgaacaccaagctggagcagccccagtccatcctcatcgagcacaagggcacgatcatcgggaagcagaacagcacatgcaccgcgaaggcctcctgctggctggagagcgtcaagtccttcttctacggcctgaagaacatgctcagcgggatcttcggcaacgtgttcatggggatcttcctgttcctggccccgttcatcctcctgatcctgttcttcatgttcggctggcgcatcctcttctgcttcaagtgctgccggcgcacccggggcctgttcaagtaccgccacctgaaggacgacgaggagaccgggtaccggcgcatcatcgagaagctcaacaacaagaagggcaagaacaagctgctggacggggagcggctcgccgacggccgcatcgccgagctgttctccacgaagacccacatcggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17086 - RNA, 3934 nt, synthetic construct
  misc_feature 1..3934: note = mRNA product Design2 comprising derived and/or modified sequence from CCHVF(10200)__U39455.2__IgE-leader_Gn-NSm-Gc (opt11)
  source 1..3934: mol_type = other RNA
ggggcgctgcctacggaggtggcagccatctccttctcggcatcaagcttaccatggactggacctggatcctgttcctcgtggcagccgcgactcgcgtacactcatccgaggagcccagcgacgactgtgtgtccagaacgcagctgttgcgcacggagacggccgagatccacggcgacaactacgggggcccgggggacaagatcaccatatgcaacggcagcaccatcgtagaccagcggctcgggtccgagctaggctgttacaccatcaaccgtgtccggagcttcaagctgtgcgaaaattcagccaccggcaaaaactgcgagatcgacagcgttcccgtgaagtgtcgccaggggtactgcctccggatcacccaggagggcagagggcacgtcaagttatctcggggcagcgaggtagtgctggacgcgtgcgacacgtcctgcgagatcatgatacccaaggggaccggcgacatcctcgtcgactgcagcggcgggcaacagcacttcctgaaggacaacctgatcgatctcggctgccccaagatcccgctactggggaaaatggccatctacatctgccgaatgtccaaccacccaaagaccaccatggcgttcctcttctggttcagcttcgggtacgtgatcacatgcattctgtgcaaggccatcttctacctgctcatcatcgtgggcaccctggggcggcgcctgaaacagtacagagagctcaagccccagacctgcaccatctgcgagaccaccccggtcaacgcgattgatgccgagatgcacgacctaaactgttcctacaacatctgcccgtactgcgcgagccgcctgacgtccgacggcctcgcccggcacgtgatccagtgccccaagcgcaaggagaaggtggaggagaccgagttatacctcaacctagagcggatcccttgggtcgttcggaagttgctccaggtgagcgagtccacgggggttgccctcaagaggagcagctggctgatcgtgctgctcgtactgttcaccgtcagtctgagccccgtgcagtccgctccgatcgggcaggggaagaccatcgaggcgtatcgggccagggagggctacaccagcatctgcctcttcgtcctgggctccatcctgttcatcgtcagctgcctgatgaaggggctggtggacagtgtcggcaacagcttcttccccgggctaagcatctgcaagacgtgcagcatctcctccatcaacggcttcgagatcgaatcccacaagtgctactgctccctcttctgctgcccctactgccgccattgctccaccgacaaggagatccacaagctgcacctgtcaatctgcaagaagaggaaaaccgggtccaacgtgatgctagccgtgtgcaagctgatgtgtttccgggctaccatggaggtcagcaaccgcgccctgttcattaggtccattatcaataccactttcgtgctctgcatcctgatcctggcggtgtgcgtcgtgagcaccagcgcagtggaaatggagaacctacctgccggcacctgggagcgggaggaggatctcacgaacttctgccaccaggagtgtcaggtcacagagaccgagtgcctttgcccgtacgaggccctggtactcaggaagcccctgtttctggactccaccgccaagggcatgaaaaacctcctgaactccacatccctggagaccagcctctccatagaggccccctggggcgcgatcaacgtgcagtcaacctacaaacccaccgtctccaccgctaacattgccctgagctggtcctcggtggagcacagggggaacaagattctggtgtccgggcggtcagagagcatcatgaagctcgaggagcgcacgggcatcagctgggatctgggggtcgaagatgcctccgagagcaagttgctcacagtgagtgtaatggacctgagccagatgtacagcccggttttcgagtacctgtccggcgaccgccaggtggaagagtggcccaaggcaacttgcacaggcgactgccccgagcggtgcgggtgcacgagctcgacctgccttcataaagagtggccacacagccggaactggcgctgcaacccgacctggtgctggggcgtggggaccgggtgtacgtgctgcgggctggacgtcaaggacctgttcaccgactacatgttcgtgaagtggaaggtggagtacatcaagaccgaggcgatcgtctgcgtggagctcacctcgcaggagcgtcagtgcagcctgatcgaggccgggacgcgcttcaacctgggccccgtgaccatcaccctctccgaaccgcggaacatccaacaaaagctgccaccggagatcatcaccctgcacccccgcattgaggagggcttcttcgacctcatgcacgtccaaaaggtgctgagcgcatctactgtgtgcaaactgcagagctgtacccacggagtacccggggacctccaagtataccacatcggtaatctgctgaagggagacaaggtgaacgggcatctcatccacaagatcgagccgcacttcaatacctcctggatgagctgggacggctgcgacctggattactattgcaacatgggggactggccgtcctgcacttatacgggcgttactcagcacaatcacgccagcttcgtgaacctactcaacatagagaccgactacaccaaaaatttccactttcactccaagcgggtgacagcacacggggacactccccaactggacctgaaggcccgccccacctatggcgccggagagataacggtcctcgtggaggtggccgacatggagctgcacacgaagaagatcgagatcagcgggttgaagttcgcctccctcgcctgcaccggatgctatgcgtgcagctccagcatctcatgcaaggtccggatccacgtggacgagccggacgagctgaccgtgcacgtaaaaagcgacgaccccgatgtcgtggccgccagctccagcctgatggcgcgcaaactcgagttcgggaccgactccaccttcaaggcgttcagcgcaatgcccaagacgagcctgtgcttctacatcgtcgagagagagcactgcaagagctgctcagaggaggacaccaaaaagtgcgtgaacaccaagctggagcagccccagagcatcctaatcgaacataaggggacaatcatcgggaagcagaactccacttgcaccgcgaaagcctcttgctggctagagtctgtaaagagcttcttctacgggctaaagaacatgctctccggcatcttcgggaatgttttcatgggcatcttcttattcctcgcgcccttcatcctcctgatcctgttctttatgttcggatggcggattctgttctgtttcaagtgctgccgccggacccgcggccttttcaagtacagacatttgaaagacgacgaggagaccgggtacagaagaatcatcgagaagctcaacaacaagaaaggcaagaacaagctgctggacggcgaacggctcgctgacgggcggatcgccgaactcttcagcacgaagacccatattggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17087 - RNA, 3355 nt, synthetic construct
  misc_feature 1..3355: note = mRNA product Design2 comprising derived and/or modified sequence from CCHVF(10200)__U39455.2__IgE-leader_Gn-4aa-Gc (opt11)
  source 1..3355: mol_type = other RNA
ggggcgctgcctacggaggtggcagccatctccttctcggcatcaagcttaccatggactggacctggatcctctttctggttgccgcagccacccgcgttcactccagcgaagaaccctcggacgactgcgttagtagaactcaactcctacggacagaaaccgcagagatccacggcgataactacggcggccccggcgacaagattactatctgcaacggcagcaccatcgtcgaccaacgactcggctcagaactaggctgctacaccattaaccgcgtccgcagcttcaaactatgcgagaacagcgcgaccgggaagaactgcgaaatcgactcagtacctgtcaaatgcagacaaggatactgcctgcgaatcacccaagaaggtcgcggacacgtcaagctatcccgcggatcagaagttgttctggacgcgtgcgacaccagttgcgaaatcatgataccaaaaggcaccggtgacattctcgtagactgcagcggcggccaacaacactttttaaaagacaacctcatcgacctcggatgcccaaaaatacctctcctcggtaaaatggctatctacatatgcaggatgtctaaccatcccaaaacaacgatggctttccttttctggttctcctttgggtacgtcataacctgcatactctgcaaagcaatcttctacctcctcatcatcgtagggacactaggacgccgattaaaacagtaccgcgagctaaaaccacaaacatgcacaatttgcgagacaacaccagtcaacgcaatcgatgctgaaatgcacgacctcaactgttcatataacatctgcccctactgcgcctcgcgtctaacctcagacggcctcgccagacacgtcatccaatgccccaagcgcaaggaaaaggtcgaagaaaccgaactatacttgaacctagaacgcatcccgtgggttgtcagaaaactgcttcaggtctcagaatctaccggagtagccctcaagcgctcatcctggctcattgtactgctcgtactctttaccgtgagcttaagcccagtccaatccgcccccatcggccgaaaaccactattcctcgattccacagccaaaggtatgaaaaacctcctcaattcgacctccctcgaaacctccctctcgatcgaagccccctggggcgccataaacgtccaatccacttacaaacctactgtgtctacagcaaatatcgccctatcctggtcttccgtagagcaccgcgggaacaaaatactcgtatctggccgctccgagagcatcatgaagctcgaagaacgcaccggaatctcctgggaccttggcgtagaggatgcgtcagaatcaaagctccttaccgtcagcgtcatggacctatcgcaaatgtactccccagtcttcgaatacctgagcggcgaccgccaggtggaagagtggcccaaagcaacctgcaccggggactgccccgaacggtgcggttgcacttcgtcaacatgccttcacaaagaatggccccacagccggaactggcgctgtaaccccacatggtgctggggcgtcggtaccggatgtacatgctgcggacttgatgtaaaggaccttttcaccgactatatgttcgttaagtggaaggttgaatacatcaaaacagaagcaatagtctgcgtcgagctcacatcccaagagcgtcaatgctccctaatagaagctggaacccgctttaacttaggtccggtcacaataacactatcagaacctcgcaatatccaacaaaagctccctcccgaaatcatcacccttcacccccgcatcgaagaaggattcttcgacctcatgcacgtccaaaaagtgctcagcgccagcacagtctgtaaactccaatcctgtacccacggcgtacccggagacctacaagtttatcacatagggaatctcctaaaaggggacaaagtcaatggccacctcatacacaaaatcgagccacacttcaacaccagctggatgtcctgggacgggtgcgatctagactactactgcaacatgggggactggccctcttgcacctacacgggagtcacacagcacaatcacgcctcattcgtaaaccttctaaacatcgaaacggactacactaaaaatttccacttccactcgaaaagggtcacagcacacggcgacacaccccagctcgacctcaaagcccgccccacctacggcgcaggagaaatcacagtactcgttgaagtagccgacatggagctacataccaagaaaatcgaaatctcaggactcaaatttgcctcactagcctgcacgggctgctacgcatgctcatcttccatctcctgcaaagtacgcatccacgtcgacgaaccagacgagctcaccgtccatgtcaaaagcgatgacccagacgtggtcgccgcttccagctctcttatggctcgaaaactagagttcggcacagactccaccttcaaggctttctcggccatgcccaaaacctcgctctgcttctacatcgttgagcgggagcactgtaaatcctgctccgaagaagataccaaaaagtgcgtcaacaccaaactcgagcaaccgcagtccattctcatcgaacacaaaggcacaatcatcggaaaacaaaacagcacatgcaccgccaaggcatcctgttggcttgaaagcgtgaagtccttcttctacggactcaaaaacatgctatccggcatcttcggcaacgtcttcatgggaatcttcctgtttctggccccctttatactcctaatactcttcttcatgttcggatggcgcatcctcttttgcttcaaatgttgcagacgaacacgcggcctcttcaaataccgccacctcaaagacgacgaagaaacgggctatcgcagaataatcgaaaaattgaacaacaagaaaggcaaaaacaaactcctggacggagaacgattagccgacggcaggatagccgaactattttcaaccaaaacgcacataggttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17088 - RNA, 1411 nt, synthetic construct
  misc_feature 1..1411: note = mRNA product Design2 comprising derived and/or modified sequence from CCHVF(10200)__U39455.2__IgE-leader_Gn (opt11)
  source 1..1411: mol_type = other RNA
ggggcgctgcctacggaggtggcagccatctccttctcggcatcaagcttaccatggactggacctggatcctcttcctagttgccgccgctacccgcgtccactcctcagaggaaccctccgacgactgcgtctcccgcactcaactcttacgcaccgaaacagccgagatccacggcgacaactacgggggacccggcgacaaaatcaccatatgcaacggctccaccatcgtcgaccaacgcctcggctcagaactcggctgctacacgatcaaccgagtccgctctttcaaactctgtgaaaactcagcaaccggcaaaaactgtgaaatcgactccgtacccgtgaaatgcagacaaggatattgcctccgaatcacccaagaaggacgcggccacgtcaaactcagccgaggctcagaagtcgtcctcgacgcctgcgacacctcatgcgaaatcatgatccccaaaggaaccggcgacatcctcgtcgactgctccggcggccaacaacacttccttaaagacaacctcatagacctcggatgccccaaaatacctctactagggaaaatggccatctacatatgccgcatgtccaaccaccccaaaacaactatggccttccttttctggttctcgttcggctacgtcatcacatgcatcctctgcaaagccatcttttacctacttatcatcgtaggcaccctaggccgccgtctaaaacaataccgcgaactcaaaccccaaacctgcaccatctgcgaaaccacccccgtaaacgccatcgacgcagaaatgcacgacctaaactgctcctacaacatctgcccatactgcgcctcccgcctaacctccgacggactcgcccgccacgtcatccaatgccccaaacgcaaagaaaaagtagaagaaacagaactatacctaaacctagaacgcataccgtgggtcgtccgtaaactcctccaagtctcagaatccaccggcgtcgcactcaaacgatcaagctggctaatcgtcctcctcgtcctcttcaccgtctcactatcccccgtccaatccgcccccatcggctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17089 - RNA, 2371 nt, synthetic construct
  misc_feature 1..2371: note = mRNA product Design2 comprising derived and/or modified sequence from CCHVF(10200)__U39455.2__IgE-leader_Gc (opt11)
  source 1..2371: mol_type = other RNA
ggggcgctgcctacggaggtggcagccatctccttctcggcatcaagcttaccatggactggacctggatcctcttcctcgtcgccgccgcaacacgcgttcacagcttcctcgacagcaccgccaagggcatgaaaaacctactcaactcgacctccctagagacatccctctccatcgaagccccctggggagccatcaacgtccaatccacctacaaaccaaccgtgtccacggccaacatagcgctaagctggtccagcgtcgagcaccgaggaaacaagatcctagtctcgggccgaagcgaatcaataatgaagctcgaggaacgcacgggaatctcatgggatctcggcgtcgaagacgcaagcgaatcaaaactccttacagtgagcgtcatggacctttcacaaatgtactcgcccgtattcgaataccttagcggagaccgccaagttgaagagtggcccaaagcgacctgcaccggcgactgccccgaacgttgtggctgtacatcgagcacatgcctacacaaagaatggccacattccagaaactggcgctgcaacccgacctggtgctggggcgtgggcacaggctgcacatgctgcggccttgacgtcaaagacctattcaccgactacatgttcgtcaaatggaaagtagaatacataaaaaccgaagcaatagtctgcgtcgaactaacctcccaagaacgacaatgctcactcatagaagctggaacccgcttcaacctcggacccgtaacgatcactctctccgaaccccgaaacatccagcaaaaactccctcccgaaatcataaccctacacccacgtatcgaagaaggcttcttcgacctaatgcacgtgcaaaaagtactcagcgcgtccaccgtttgcaaactccaatcttgcactcacggcgtacccggcgacctgcaagtctaccacatcggcaacctcctcaagggcgacaaagtaaatggtcacctgatccacaaaatcgagccccacttcaacacctcctggatgagctgggacggatgcgacctcgactactactgcaacatgggagactggccctcatgcacgtacaccggcgtcacccaacacaaccacgcctcattcgtaaacctgctgaacatcgaaaccgactataccaagaacttccacttccacagcaaaagagtcaccgcccacggcgacacaccccaattagacctcaaagcccgccccacctacggcgccggcgaaataaccgtcctcgtcgaagtcgcagacatggaactacacacaaagaaaatagaaatttccggcctgaaattcgcatcactcgcatgcacaggctgctacgcgtgctcaagctcaatatcctgtaaagtccgaatccacgtagatgaaccagacgagctcaccgtacacgtcaagtcagacgacccagacgtagtagcggcctcatcctccctcatggcacgaaaactagagttcggcacagactcaacattcaaagcattcagcgcaatgccaaaaacctccctttgcttctacatcgtcgaacgcgaacactgcaaaagctgcagcgaagaagacacaaagaaatgcgttaacaccaaacttgaacaaccccaaagcatcctgatagaacacaaaggcactatcatcggaaagcagaactcaacctgcactgccaaggccagctgctggctcgaaagcgtgaaatcattcttttacggactgaaaaacatgctaagcggcattttcggtaacgtattcatgggcatcttcctcttcctggccccgttcatcctcttaatactatttttcatgttcggctggagaatcctattctgtttcaaatgctgccgccgcacgcgcggcctttttaaatatcgccaccttaaggacgatgaagaaaccggctaccgccgaataatagaaaaactaaacaacaaaaagggcaaaaacaaactcctcgacggcgaacgccttgcagacggccgcatagccgaactcttcagcacaaaaacccacataggctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17090 - protein, 235 aa, synthetic construct; identical to SEQ ID NO: 792
  REGION 1..235: note = derived and/or modified protein sequence (wt) from LACV(Human/78)__NC_004110.1__N

SEQ ID NO: 17091 - protein, 1441 aa, synthetic construct; identical to SEQ ID NO: 1929
  REGION 1..1441: note = derived and/or modified protein sequence (wt) from LACV(Human/78)__NC_004109.1__GP

SEQ ID NO: 17092 - protein, 1446 aa, synthetic construct
  REGION 1..1446: note = derived and/or modified protein sequence (wt) from LACV(Human/78)__NC_004109.1__IgE-leader_Gn-NSm-Gc
MDWTWILFLVAAATRVHSSPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARVMCKSKGPASILSIITAVLVLTFVTPINSMVLGESKETFELEDLPDDMLEMASRINSYYLTCILNYAVSWGLVIIGLLIGLLFKKYQHRFLNVYAMYCEECDMYHDKSGLKRHGDFTNKCRQCTCGQYEDAAGLMAHRKTYNCLVQYKAKWMMNFLIIYIFLILIKDSAIVVQAAGTDFTTCLETESINWNCTGPFLNLGNCQKQQKKEPYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 17093 - protein, 1231 aa, synthetic construct
  REGION 1..1231: note = derived and/or modified protein sequence (wt) from LACV(Human/78)__NC_004109.1__SP-GP_Gn-4aa-Gc
MICILVLITVAAASPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 17094 - protein, 1236 aa, synthetic construct
  REGION 1..1236: note = derived and/or modified protein sequence (wt) from LACV(Human/78)__NC_004109.1__IgE-leader_Gn-4aa-Gc
MDWTWILFLVAAATRVHSSPVYQRCFQDGAIVKQNPSKEAVTEVCLKDDVSMIKTEARYVRNATGVFSNNVAIRKWLVSDWHDCRPKKIVGGHINVIEVGDDLSLHTESYVCSADCTIGVDKETAQVRLQTDTTNHFEIAGTTVKSGWFKSTTYITLDQTCEHLKVSCGPKSVQFHACFNQHMSCVRFLHRTILPGSIANSICQNIEIIILVTLTLLIFILLSILSKTYICYLLMPIFIPIAYIYGIIYNKSCKKCKLCGLVYHPFTECGTHCVCGARYDTSDRMKLHRASGLCPGYKSLRAARYTNIATQLKGLKAISVLDVPIITGIPDDIAGALRYIEEKEDFHVQLTIEYAMLSKYCDYYTQFSDNSGYSQTTWRVYLRSHDFEACILYPNQHFCRCVKNGEKCSSSNWDFANEMKDYYSGKQTKFDKDLNLALTALHHAFRGTSSAYIATMLSKKSNDDLIAYTNKIKTKFPGNALLKAIIDYIAYMKSLPGMANFKYDEFWDELLYKPNPAKASNLARGKESSYNFKLAISSKSIKTCKNVKDVACLSPRSGAIYASIIACGEPNGPSVYRKPSGGVFQSSTDRSIYCLLDSHCLEEFEAIGQEELDAVKKSKCWEIEYPDVKLIQEGDGTKSCRMKDSGNCNVATNRWPVIQCENDKFYYSELQKDYDKAQDIGHYCLSPGCTTVRYPINPKHISNCNWQVSRSSIAKIDVHNIEDIEQYKKAITQKLQTSLSLFKYAKTKNLPHIKPIYKYITIEGTETAEGIESAYIESEVPALAGTSIGFKINSKEGKHLLDVIAYVKSASYSSVYTKLYSTGPTSGINTKHDELCTGPCPANINHQVGWLTFARERTSSWGCEEFGCLAVSDGCVFGSCQDIIKEELSVYRKETEEVTDVELCLTFSDKTYCTNLNPVTPIITDLFEVQFKTVETYSLPRIVAVQNHEIKIGQINDLGVYSKGCGNVQKVNGTIYGNGVPRFDYLCHLASRKEVIVRKCFDNDYQACKFLQSPASYRLEEDSGTVTIIDYKKILGTIKMKAILGDVKYKTFADSVDITAEGSCTGCINCFENIHCELTLHTTIEASCPIKSSCTVFHDRILVTPNEHKYALKMVCTEKPGNTLTIKVCNTKVEASMALVDAKPIIELAPVDQTAYIREKDERCKTWMCRVRDEGLQVILEPFKNLFGSYIGIFYTFIISIVVLLVIIYVLLPICFKLRDTLRKHEDAYKREMKIR

SEQ ID NO: 17095 - RNA, 708 nt, synthetic construct; identical to SEQ ID NO: 3127
  misc_feature 1..708: note = derived and/or modified CDS sequence (wt) from LACV(Human/78)__NC_004109.1__N
  source 1..708: mol_type = other RNA

SEQ ID NO: 17096 - RNA, 708 nt, synthetic construct
  misc_feature 1..708: note = derived and/or modified CDS sequence (wt) from LACV(Human/78)__NC_004109.1__N
  source 1..708: mol_type = other RNA
atgtcggatttggtgttttatgatgtcgcatcaacaggtgcaaatggatttgatcctgatgcagggtatatggacttctgtgttaaaaatgcagaattactcaaccttgctgcagttaggatcttcttcctcaatgccgcaaaggccaaggctgctctctcgcgtaagccagagaggaaggctaaccctaaatttggagagtggcaggtcgaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtaggatgggacagtgggccagagatctatctatcattctttccaggaacagaaatgtttttggaaactttcaaattctacccgctgaccattggaatccacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataa

SEQ ID NO: 17097 - RNA, 4326 nt, synthetic construct; identical to SEQ ID NO: 4264
  misc_feature 1..4326: note = derived and/or modified CDS sequence (wt) from LACV(Human/78)__NC_004109.1__GP
  source 1..4326: mol_type = other RNA

SEQ ID NO: 17098 - RNA, 4326 nt, synthetic construct
  misc_feature 1..4326: note = derived and/or modified CDS sequence (wt) from LACV(Human/78)__NC_004109.1__GP
  source 1..4326: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17099 - RNA, 4341 nt, synthetic construct
  misc_feature 1..4341: note = derived and/or modified CDS sequence (wt) from LACV(Human/78)__NC_004109.1__IgE-leader_Gn-NSm-Gc
  source 1..4341: mol_type = other RNA
atggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17100 - RNA, 4341 nt, synthetic construct
  misc_feature 1..4341: note = derived and/or modified CDS sequence (wt) from LACV(Human/78)__NC_004109.1__IgE-leader_Gn-NSm-Gc
  source 1..4341: mol_type = other RNA
atggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17101 - RNA, 3696 nt, synthetic construct
  misc_feature 1..3696: note = derived and/or modified CDS sequence (wt) from LACV(Human/78)__NC_004109.1__SP-GP_Gn-4aa-Gc
  source 1..3696: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17102 - RNA, 3696 nt, synthetic construct
  misc_feature 1..3696: note = derived and/or modified CDS sequence (wt) from LACV(Human/78)__NC_004109.1__SP-GP_Gn-4aa-Gc
  source 1..3696: mol_type = other RNA
atgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17103 - RNA, 3711 nt, synthetic construct
  misc_feature 1..3711: note = derived and/or modified CDS sequence (wt) from LACV(Human/78)__NC_004109.1__IgE-leader_Gn-4aa-Gc
  source 1..3711: mol_type = other RNA
atggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17104 - RNA, 3711 nt, synthetic construct
  misc_feature 1..3711: note = derived and/or modified CDS sequence (wt) from LACV(Human/78)__NC_004109.1__IgE-leader_Gn-4aa-Gc
  source 1..3711: mol_type = other RNA
atggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatag

SEQ ID NO: 17105 - RNA, 708 nt, synthetic construct; identical to SEQ ID NO: 5462
  misc_feature 1..708: note = derived and/or modified CDS sequence (opt4) from LACV(Human/78)__NC_004109.1__N
  source 1..708: mol_type = other RNA

SEQ ID NO: 17106 - RNA, 4326 nt, synthetic construct; identical to SEQ ID NO: 9367
  misc_feature 1..4326: note = derived and/or modified CDS sequence (opt4) from LACV(Human/78)__NC_004109.1__GP
  source 1..4326: mol_type = other RNA

SEQ ID NO: 17107 - RNA, 4341 nt, synthetic construct
  misc_feature 1..4341: note = derived and/or modified CDS sequence (opt4) from LACV(Human/78)__NC_004109.1__IgE-leader_Gn-NSm-Gc
  source 1..4341: mol_type = other RNA
atggactggacctggatcctgttcctcgtggccgctgcaacaagagtccacagcagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatga

SEQ ID NO: 17108 - RNA, 3696 nt, synthetic construct
  misc_feature 1..3696: note = derived and/or modified CDS sequence (opt4) from LACV(Human/78)__NC_004109.1__SP-GP_Gn-4aa-Gc
  source 1..3696: mol_type = other RNA
atgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagatacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatga

SEQ ID NO: 17109 - RNA, 3711 nt, synthetic construct
  misc_feature 1..3711: note = derived and/or modified CDS sequence (opt4) from LACV(Human/78)__NC_004109.1__IgE-leader_Gn-4aa-Gc
  source 1..3711: mol_type = other RNA
atggactggacctggatcctgttcctcgtggccgctgcaacaagagtccacagcagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagatacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatga

SEQ ID NO: 17110 - RNA, 708 nt, synthetic construct; identical to SEQ ID NO: 6154
  misc_feature 1..708: note = derived and/or modified CDS sequence (opt3) from LACV(Human/78)__NC_004109.1__N
  source 1..708: mol_type = other RNA

SEQ ID NO: 17111 - RNA, 4326 nt, synthetic construct; identical to SEQ ID NO: 11010
  misc_feature 1..4326: note = derived and/or modified CDS sequence (opt3) from LACV(Human/78)__NC_004109.1__GP
  source 1..4326: mol_type = other RNA

SEQ ID NO: 17112 - RNA, 4341 nt, synthetic construct
  misc_feature 1..4341: note = derived and/or modified CDS sequence (opt3) from LACV(Human/78)__NC_004109.1__IgE-leader_Gn-NSm-Gc
  source 1..4341: mol_type = other RNA
atggactggacctggatcctgttcctcgtggccgctgcaacaagagtccacagcagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtga

SEQ ID NO: 17113 - RNA, 3696 nt, synthetic construct
  misc_feature 1..3696: note = derived and/or modified CDS sequence (opt3) from LACV(Human/78)__NC_004109.1__SP-GP_Gn-4aa-Gc
  source 1..3696: mol_type = other RNA
atgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcggtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtga

SEQ ID NO: 17114 - RNA, 3711 nt, synthetic construct
  misc_feature 1..3711: note = derived and/or modified CDS sequence (opt3) from LACV(Human/78)__NC_004109.1__IgE-leader_Gn-4aa-Gc
  source 1..3711: mol_type = other RNA
atggactggacctggatcctgttcctcgtggccgctgcaacaagagtccacagcagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcggtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtga

SEQ ID NO: 17115 - RNA, 708 nt, synthetic construct; identical to SEQ ID NO: 6846
  misc_feature 1..708: note = derived and/or modified CDS sequence (opt1) from LACV(Human/78)__NC_004110.1__N
  source 1..708: mol_type = other RNA

SEQ ID NO: 17116 - RNA, 4326 nt, synthetic construct; identical to SEQ ID NO: 12653
  misc_feature 1..4326: note = derived and/or modified CDS sequence (opt1) from LACV(Human/78)__NC_004109.1__GP
  source 1..4326: mol_type = other RNA

SEQ ID NO: 17117 - RNA, 4341 nt, synthetic construct
  misc_feature 1..4341: note = derived and/or modified CDS sequence (opt1) from LACV(Human/78)__NC_004109.1__IgE-leader_Gn-NSm-Gc
  source 1..4341: mol_type = other RNA
atggactggacctggatcctgttcctcgtggccgccgcgacccgcgtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtga

SEQ ID NO: 17118 - RNA, 3696 nt, synthetic construct
  misc_feature 1..3696: note = derived and/or modified CDS sequence (opt1) from LACV(Human/78)__NC_004109.1__SP-GP_Gn-4aa-Gc
  source 1..3696: mol_type = other RNA
atgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtga

SEQ ID NO: 17119 - RNA, 3711 nt, synthetic construct
  misc_feature 1..3711: note = derived and/or modified CDS sequence (opt1) from LACV(Human/78)__NC_004109.1__IgE-leader_Gn-4aa-Gc
  source 1..3711: mol_type = other RNA
atggactggacctggatcctgttcctcgtggccgccgcgacccgcgtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtga

SEQ ID NO: 17120 - RNA, 708 nt, synthetic construct; identical to SEQ ID NO: 7538
  misc_feature 1..708: note = derived and/or modified CDS sequence (opt5) from LACV(Human/78)__NC_004109.1__N
  source 1..708: mol_type = other RNA

SEQ ID NO: 17121 - RNA, 4326 nt, synthetic construct; identical to SEQ ID NO: 14296
  misc_feature 1..4326: note = derived and/or modified CDS sequence (opt5) from LACV(Human/78)__NC_004109.1__GP
  source 1..4326: mol_type = other RNA

SEQ ID NO: 17122 - RNA, 4341 nt, synthetic construct
  misc_feature 1..4341: note = derived and/or modified CDS sequence (opt5) from LACV(Human/78)__NC_004109.1__IgE-leader_Gn-NSm-Gc
  source 1..4341: mol_type = other RNA
atggactggacctggatcctgttcctcgtggccgctgcaacaagagtccacagcagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggcctcctgttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctga

SEQ ID NO: 17123 - RNA, 3696 nt, synthetic construct
  misc_feature 1..3696: note = derived and/or modified CDS sequence (opt5) from LACV(Human/78)__NC_004109.1__SP-GP_Gn-4aa-Gc
  source 1..3696: mol_type = other RNA
atgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagatatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctga

SEQ ID NO: 17124 - RNA, 3711 nt, synthetic construct
  misc_feature 1..3711: note = derived and/or modified CDS sequence (opt5) from LACV(Human/78)__NC_004109.1__IgE-leader_Gn-4aa-Gc
  source 1..3711: mol_type = other RNA
atggactggacctggatcctgttcctcgtggccgctgcaacaagagtccacagcagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagatatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctga

SEQ ID NO: 17125 - RNA, 708 nt, synthetic construct; identical to SEQ ID NO: 8230
  misc_feature 1..708: note = derived and/or modified CDS sequence (opt11) from LACV(Human/78)__NC_004109.1__N
  source 1..708: mol_type = other RNA

SEQ ID NO: 17126 - RNA, 4326 nt, synthetic construct; identical to SEQ ID NO: 12653
  misc_feature 1..4326: note = derived and/or modified CDS sequence (opt11) from LACV(Human/78)__NC_004109.1__GP
  source 1..4326: mol_type = other RNA

SEQ ID NO: 17127 - RNA, 4341 nt, synthetic construct
  misc_feature 1..4341: note = derived and/or modified CDS sequence (opt11) from LACV(Human/78)__NC_004109.1__IgE-leader_Gn-NSm-Gc
  source 1..4341: mol_type = other RNA
atggactggacctggatcctgttcctcgtggccgctgcaacaagagtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtga

SEQ ID NO: 17128 - RNA, 3696 nt, synthetic construct; identical to SEQ ID NO: 17118
  misc_feature 1..3696: note = derived and/or modified CDS sequence (opt11) from LACV(Human/78)__NC_004109.1__SP-GP_Gn-4aa-Gc
  source 1..3696: mol_type = other RNA

SEQ ID NO: 17129 - RNA, 3711 nt, synthetic construct
  misc_feature 1..3711: note = derived and/or modified CDS sequence (opt11) from LACV(Human/78)__NC_004109.1__IgE-leader_Gn-4aa-Gc
  source 1..3711: mol_type = other RNA
atggactggacctggatcctgttcctcgtggccgctgcaacaagagtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtga

SEQ ID NO: 17130 - RNA, 925 nt, synthetic construct
  misc_feature 1..925: note = mRNA product Design1 comprising derived and/or modified sequence from LACV(Human/78)__NC_004109.1__N (wt)
  source 1..925: mol_type = other RNA
gggagaaagcttaccatgtcggatttggtgttttatgatgtcgcatcaacaggtgcaaatggatttgatcctgatgcagggtatatggacttctgtgttaaaaatgcagaattactcaaccttgctgcagttaggatcttcttcctcaatgccgcaaaggccaaggctgctctctcgcgtaagccagagaggaaggctaaccctaaatttggagagtggcaggtggaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtaggatgggacagtgggccagagatctatctatcattctttccaggaacagaaatgtttttggaaactttcaaattctacccgctgaccattggaattcacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17131 - RNA, 925 nt, synthetic construct
  misc_feature 1..925: note = mRNA product Design1 comprising derived and/or modified sequence from LACV(Human/78)__NC_004109.1__N (wt)
  source 1..925: mol_type = other RNA
gggagaaagcttaccatgtcggatttggtgttttatgatgtcgcatcaacaggtgcaaatggatttgatcctgatgcagggtatatggacttctgtgttaaaaatgcagaattactcaaccttgctgcagttaggatcttcttcctcaatgccgcaaaggccaaggctgctctctcgcgtaagccagagaggaaggctaaccctaaatttggagagtggcaggtcgaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtaggatgggacagtgggccagagatctatctatcattctttccaggaacagaaatgtttttggaaactttcaaattctacccgctgaccattggaatccacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17132 - RNA, 4543 nt, synthetic construct
  misc_feature 1..4543: note = mRNA product Design1 comprising derived and/or modified sequence from LACV(Human/78)__NC_004109.1__GP (wt)
  source 1..4543: mol_type = other RNA
gggagaaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17133 - RNA, 4543 nt, synthetic construct
  misc_feature 1..4543: note = mRNA product Design1 comprising derived and/or modified sequence from LACV(Human/78)__NC_004109.1__GP (wt)
  source 1..4543: mol_type = other RNA
gggagaaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17134 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (wt)
  source 1..4558: mol_type = other RNA
gggagaaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17135 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (wt)
  source 1..4558: mol_type = other RNA
gggagaaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17136 - RNA, 3913 nt, synthetic construct
  misc_feature 1..3913: note = mRNA product Design1 comprising derived and/or modified sequence from LACV(Human/78)__NC_004109.1__SP-GP_Gn-4aa-Gc (wt)
  source 1..3913: mol_type = other RNA
gggagaaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17137 - RNA, 3913 nt, synthetic construct
  misc_feature 1..3913: note = mRNA product Design1 comprising derived and/or modified sequence from LACV(Human/78)__NC_004109.1__SP-GP_Gn-4aa-Gc (wt)
  source 1..3913: mol_type = other RNA
gggagaaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17138 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (wt)
  source 1..3928: mol_type = other RNA
gggagaaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17139 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (wt)
  source 1..3928: mol_type = other RNA
gggagaaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17140 - RNA, 925 nt, synthetic construct
  misc_feature 1..925: note = mRNA product Design1 comprising derived and/or modified sequence from LACV(Human/78)__NC_004109.1__N (opt4)
  source 1..925: mol_type = other RNA
gggagaaagcttaccatgagcgacctggtgttctacgacgtggccagcaccggcgccaacggcttcgaccccgacgccggctacatggacttctgcgtgaagaacgccgagctgctgaacctggccgccgtgagaatcttcttcctgaacgccgccaaggccaaggccgccctgagcagaaagcccgagagaaaggccaaccccaagttcggcgagtggcaggtggaggtgatcaacaaccacttccccggcaacagaaacaaccccatcggcaacaacgacctgaccatccacagactgagcggctacctggccagatgggtgctggaccagtacaacgagaacgacgacgagagccagcacgagctgatcagaaccaccatcatcaaccccatcgccgagagcaacggcgtgggctgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17141 - RNA, 4543 nt, synthetic construct
  misc_feature 1..4543: note = mRNA product Design1 comprising derived and/or modified sequence from LACV(Human/78)__NC_004109.1__GP (opt4)
  source 1..4543: mol_type = other RNA
gggagaaagcttaccatgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17142 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (opt4)
  source 1..4558: mol_type = other RNA
gggagaaagcttaccatggactggacctggatcctgttcctcgtggccgctgcaacaagagtccacagcagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17143 - RNA, 3913 nt, synthetic construct
  misc_feature 1..3913: note = mRNA product Design1 comprising derived and/or modified sequence from LACV(Human/78)__NC_004109.1__SP-GP_Gn-4aa-Gc (opt4)
  source 1..3913: mol_type = other RNA
gggagaaagcttaccatgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagatacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17144 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (opt4)
  source 1..3928: mol_type = other RNA
gggagaaagcttaccatggactggacctggatcctgttcctcgtggccgctgcaacaagagtccacagcagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagatacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17145 - RNA, 925 nt, synthetic construct
  misc_feature 1..925: note = mRNA product Design1 comprising derived and/or modified sequence from LACV(Human/78)__NC_004109.1__N (opt3)
  source 1..925: mol_type = other RNA
gggagaaagcttaccatgagcgacctggtgttctacgatgtcgcctccaccggcgctaacgggtttgaccccgatgcaggatatatggacttctgcgttaagaatgccgagctccttaacctggcggctgtgagaatctttttcttgaatgccgcaaaagccaaggctgcattatctaggaaacctgaacggaaggccaacccaaaatttggtgagtggcaggtagaagtgattaataaccacttcccgggcaatcgcaacaatcccatagggaacaatgatctgacaatccatcgactatcaggatacctcgctcgttgggtcctggaccaatataacgagaatgatgacgaaagtcagcacgagcttattagaactacgatcattaaccctatcgccgagagcaatggcgtgggttgggattccgggccagaaatatacctgtcgtttttccccggaaccgagatgtttttggaaacattcaagttttatcctctcactatcggcattcatagggttaagcagggcatgatggacccacagtacctgaaaaaggcgctgcggcaacgctatgggaccctcacagcagataaatggatgtctcagaaggtggccgctatcgccaaatcattaaaggacgtcgagcagctgaagtggggaaaaggtggccttagcgataccgcaaagactttcttgcagaaatttgggattagactgccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17146 - RNA, 4543 nt, synthetic construct
  misc_feature 1..4543: note = mRNA product Design1 comprising derived and/or modified sequence from LACV(Human/78)__NC_004109.1__GP (opt3)
  source 1..4543: mol_type = other RNA
gggagaaagcttaccatgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17147 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (opt3)
  source 1..4558: mol_type = other RNA
gggagaaagcttaccatggactggacctggatcctgttcctcgtggccgctgcaacaagagtccacagcagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17148 - RNA, 3913 nt, synthetic construct
  misc_feature 1..3913: note = mRNA product Design1 comprising derived and/or modified sequence from LACV(Human/78)__NC_004109.1__SP-GP_Gn-4aa-Gc (opt3)
  source 1..3913: mol_type = other RNA
gggagaaagcttaccatgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcggtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17149 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (opt3)
  source 1..3928: mol_type = other RNA
gggagaaagcttaccatggactggacctggatcctgttcctcgtggccgctgcaacaagagtccacagcagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcggtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17150 - RNA, 925 nt, synthetic construct
  misc_feature 1..925: note = mRNA product Design1 comprising derived and/or modified sequence from LACV(Human/78)__NC_004110.1__N (opt1)
  source 1..925: mol_type = other RNA
gggagaaagcttaccatgagcgacctggtgttctacgacgtcgcctccaccggcgccaacgggttcgaccccgacgcgggctacatggacttctgcgtgaagaacgccgagctcctgaacctggccgccgtgcgcatcttcttcctcaacgccgcgaaggccaaggccgccctgagccggaagccggagcgcaaggcgaaccccaagttcggggagtggcaggtcgaggtgatcaacaaccacttccccggcaaccggaacaaccccatcgggaacaacgacctgaccatccaccgcctctccggctacctggcccggtgggtgctggaccagtacaacgagaacgacgacgagagccagcacgagctcatccgcacgaccatcatcaacccgatcgccgagtccaacggcgtcgggtgggacagcggccccgagatctacctgtccttcttccccgggaccgagatgttcctggagaccttcaagttctaccccctcacgatcggcatccaccgggtgaagcaggggatgatggacccgcagtacctgaagaaggccctgcgccagcggtacggcaccctcaccgccgacaagtggatgagccagaaggtggcggccatcgccaagtccctgaaggacgtcgagcagctgaagtggggcaagggcgggctcagcgacaccgccaagacgttcctgcagaagttcgggatccgcctgccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17151 - RNA, 4543 nt, synthetic construct
  misc_feature 1..4543: note = mRNA product Design1 comprising derived and/or modified sequence from LACV(Human/78)__NC_004109.1__GP (opt1)
  source 1..4543: mol_type = other RNA
gggagaaagcttaccatgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17152 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (opt1)
  source 1..4558: mol_type = other RNA
gggagaaagcttaccatggactggacctggatcctgttcctcgtggccgccgcgacccgcgtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17153 - RNA, 3913 nt, synthetic construct
  misc_feature 1..3913: note = mRNA product Design1 comprising derived and/or modified sequence from LACV(Human/78)__NC_004109.1__SP-GP_Gn-4aa-Gc (opt1)
  source 1..3913: mol_type = other RNA
gggagaaagcttaccatgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17154 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (opt1)
  source 1..3928: mol_type = other RNA
gggagaaagcttaccatggactggacctggatcctgttcctcgtggccgccgcgacccgcgtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17155 - RNA, 925 nt, synthetic construct
  misc_feature 1..925: note = mRNA product Design1 comprising derived and/or modified sequence from LACV(Human/78)__NC_004109.1__N (opt5)
  source 1..925: mol_type = other RNA
gggagaaagcttaccatgagcgacctggtgttctacgatgtcgcctccaccggcgctaacgggtttgaccccgatgccggatatatggacttctgcgttaagaatgcggagctcctgaaccttgctgccgtgagaatctttttcctgaatgccgctaaagccaaggctgccctctctcggaaacctgaacgcaaggcgaacccgaaatttggcgagtggcaagtggaagtcattaataaccacttccccgggaatagaaacaatcctatcggaaacaatgatctgacaattcatcggcttagcggctacctggcccgctgggtgctcgaccagtataacgagaatgatgacgaatcccagcacgagctgatcagaacgaccattatcaaccccatcgctgagtctaatggggttggatgggatagcggccctgaaatttacctgtcctttttccccggcacagagatgtttctcgaaaccttcaagttttatcctctgacaatcgggattcatcgggtgaagcagggaatgatggacccgcagtaccttaaaaaggccctgcgccaaagatatggcaccctcacagctgataaatggatgtctcagaaggtcgccgcgatcgccaaaagcctgaaggacgtggagcagcttaagtgggggaaaggaggcctgtccgataccgctaagacgttcctccagaaatttgggattcggctgccctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17156 - RNA, 4543 nt, synthetic construct
  misc_feature 1..4543: note = mRNA product Design1 comprising derived and/or modified sequence from LACV(Human/78)__NC_004109.1__GP (opt5)
  source 1..4543: mol_type = other RNA
gggagaaagcttaccatgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggcctcctgttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17157 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (opt5)
  source 1..4558: mol_type = other RNA
gggagaaagcttaccatggactggacctggatcctgttcctcgtggccgctgcaacaagagtccacagcagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggcctcctgttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17158 - RNA, 3913 nt, synthetic construct
  misc_feature 1..3913: note = mRNA product Design1 comprising derived and/or modified sequence from LACV(Human/78)__NC_004109.1__SP-GP_Gn-4aa-Gc (opt5)
  source 1..3913: mol_type = other RNA
gggagaaagcttaccatgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagatatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17159 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (opt5)
  source 1..3928: mol_type = other RNA
gggagaaagcttaccatggactggacctggatcctgttcctcgtggccgctgcaacaagagtccacagcagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagatatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17160 - RNA, 925 nt, synthetic construct
  misc_feature 1..925: note = mRNA product Design1 comprising derived and/or modified sequence from LACV(Human/78)__NC_004109.1__N (opt11)
  source 1..925: mol_type = other RNA
gggagaaagcttaccatgtccgacctcgtattctacgacgtagcctcaacaggcgccaacggattcgacccagacgccggatacatggacttctgcgtcaaaaacgccgaactcctcaacctcgccgccgtccgcatcttcttcctcaacgccgccaaagccaaagcagccctatcccgcaaacccgaacgaaaagccaaccccaaattcggcgaatggcaagtcgaagtcatcaacaaccacttccccggcaaccgcaacaacccaatcggcaacaacgacctcaccatacaccgactttccggctacctcgcccgatgggtcctcgaccaatacaacgaaaacgacgacgaatcccaacacgaactaatacgcacaaccatcatcaaccccatcgccgagtccaacggcgtcggctgggactccggacccgaaatatacctctccttcttccccggcacagaaatgttcctagaaaccttcaaattctacccactcactatcggcatccacagagtaaaacaaggaatgatggacccccaatacctcaaaaaagccctacgacaacgctacggaacccttaccgccgacaaatggatgtcacaaaaagtcgccgccatcgccaaatccctcaaagacgtagaacaactcaaatggggaaaaggcggcctctcagacaccgccaaaaccttcctccaaaaattcggcatccgactcccataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17161 - RNA, 4543 nt, synthetic construct; identical to SEQ ID NO: 17151
  misc_feature 1..4543: note = mRNA product Design1 comprising derived and/or modified sequence from LACV(Human/78)__NC_004109.1__GP (opt11)
  source 1..4543: mol_type = other RNA

SEQ ID NO: 17162 - RNA, 4558 nt, synthetic construct
  misc_feature 1..4558: note = mRNA product Design1 comprising derived and/or modified sequence from LACV(Human/78)__NC_004109.1__IgE-leader_Gn-NSm-Gc (opt11)
  source 1..4558: mol_type = other RNA
gggagaaagcttaccatggactggacctggatcctgttcctcgtggccgctgcaacaagagtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17163 - RNA, 3913 nt, synthetic construct; identical to SEQ ID NO: 17153
  misc_feature 1..3913: note = mRNA product Design1 comprising derived and/or modified sequence from LACV(Human/78)__NC_004109.1__SP-GP_Gn-4aa-Gc (opt11)
  source 1..3913: mol_type = other RNA

SEQ ID NO: 17164 - RNA, 3928 nt, synthetic construct
  misc_feature 1..3928: note = mRNA product Design1 comprising derived and/or modified sequence from LACV(Human/78)__NC_004109.1__IgE-leader_Gn-4aa-Gc (opt11)
  source 1..3928: mol_type = other RNA
gggagaaagcttaccatggactggacctggatcctgttcctcgtggccgctgcaacaagagtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17165 - RNA, 1090 nt, synthetic construct
  misc_feature 1..1090: note = mRNA product Design2 comprising derived and/or modified sequence from LACV(Human/78)__NC_004109.1__N (wt)
  source 1..1090: mol_type = other RNA
ggggcgctgcctacggaggtggcagccatctccttctcggcatcaagcttaccatgtcggatttggtgttttatgatgtcgcatcaacaggtgcaaatggatttgatcctgatgcagggtatatggacttctgtgttaaaaatgcagaattactcaaccttgctgcagttaggatcttcttcctcaatgccgcaaaggccaaggctgctctctcgcgtaagccagagaggaaggctaaccctaaatttggagagtggcaggtggaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtaggatgggacagtgggccagagatctatctatcattctttccaggaacagaaatgtttttggaaactttcaaattctacccgctgaccattggaattcacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17166 - RNA, 1090 nt, synthetic construct
  misc_feature 1..1090: note = mRNA product Design2 comprising derived and/or modified sequence from LACV(Human/78)__NC_004109.1__N (wt)
  source 1..1090: mol_type = other RNA
ggggcgctgcctacggaggtggcagccatctccttctcggcatcaagcttaccatgtcggatttggtgttttatgatgtcgcatcaacaggtgcaaatggatttgatcctgatgcagggtatatggacttctgtgttaaaaatgcagaattactcaaccttgctgcagttaggatcttcttcctcaatgccgcaaaggccaaggctgctctctcgcgtaagccagagaggaaggctaaccctaaatttggagagtggcaggtcgaggttatcaataatcattttcctggaaacaggaacaacccaattggtaacaacgatcttaccatccacagattatctgggtatttagccagatgggtccttgatcagtataacgagaatgatgatgagtctcagcacgagttgatcagaacaactattatcaacccaattgctgagtctaatggtgtaggatgggacagtgggccagagatctatctatcattctttccaggaacagaaatgtttttggaaactttcaaattctacccgctgaccattggaatccacagagtcaagcaaggcatgatggaccctcaatacctgaagaaggccttaaggcaacgctatggcactctcacagcagataagtggatgtcacagaaggttgcagcaattgctaagagcctgaaggatgtagagcagcttaaatggggaaaaggaggcctgagcgatactgctaaaacattcctgcagaaatttggcatcaggcttccataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17167 - RNA, 4708 nt, synthetic construct
  misc_feature 1..4708: note = mRNA product Design2 comprising derived and/or modified sequence from LACV(Human/78)__NC_004109.1__GP (wt)
  source 1..4708: mol_type = other RNA
ggggcgctgcctacggaggtggcagccatctccttctcggcatcaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17168 - RNA, 4708 nt, synthetic construct
  misc_feature 1..4708: note = mRNA product Design2 comprising derived and/or modified sequence from LACV(Human/78)__NC_004109.1__GP (wt)
  source 1..4708: mol_type = other RNA
ggggcgctgcctacggaggtggcagccatctccttctcggcatcaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17169 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (wt)
  source 1..4723: mol_type = other RNA
ggggcgctgcctacggaggtggcagccatctccttctcggcatcaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17170 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (wt)
  source 1..4723: mol_type = other RNA
ggggcgctgcctacggaggtggcagccatctccttctcggcatcaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagagtcatgtgcaagtcgaaagggcctgcatcaatattgtctataattactgcggtactggtcttaacctttgtgacaccaatcaactccatggttttaggagagagtaaagaaacctttgaacttgaagatcttccagacgacatgttggaaatggcatcgagaataaattcttattatctcacctgtatcttgaattatgctgtaagctggggtcttgttatcattggattgttgatcgggctgctttttaagaaataccagcacagattcttaaatgtttacgcaatgtactgtgaagaatgtgacatgtatcatgacaagtctgggttgaaaagacatggtgatttcaccaacaaatgcagacagtgcacatgtggtcaatatgaagatgctgcaggtttgatggctcacaggaaaacctataactgcttagtgcagtacaaagcaaagtggatgatgaacttcctgataatttacatattcttaattttgatcaaagattctgctatagttgtacaagctgctggaactgacttcaccacctgcctagagactgagagtataaattggaactgcactgggccatttttgaacctcgggaattgccaaaagcaacaaaagaaagaaccttacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17171 - RNA, 4078 nt, synthetic construct
  misc_feature 1..4078: note = mRNA product Design2 comprising derived and/or modified sequence from LACV(Human/78)__NC_004109.1__SP-GP_Gn-4aa-Gc (wt)
  source 1..4078: mol_type = other RNA
ggggcgctgcctacggaggtggcagccatctccttctcggcatcaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17172 - RNA, 4078 nt, synthetic construct
  misc_feature 1..4078: note = mRNA product Design2 comprising derived and/or modified sequence from LACV(Human/78)__NC_004109.1__SP-GP_Gn-4aa-Gc (wt)
  source 1..4078: mol_type = other RNA
ggggcgctgcctacggaggtggcagccatctccttctcggcatcaagcttaccatgatttgtatattggtgctaattacagttgcagctgcaagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17173 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (wt)
  source 1..4093: mol_type = other RNA
ggggcgctgcctacggaggtggcagccatctccttctcggcatcaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgaattctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17174 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (wt)
  source 1..4093: mol_type = other RNA
ggggcgctgcctacggaggtggcagccatctccttctcggcatcaagcttaccatggactggacctggatcctgttcctcgtggccgccgcgacccgcgtccacagcagcccagtgtatcaaaggtgtttccaagatggggctatagtgaagcaaaacccatccaaagaagcagttacagaggtgtgcctgaaagatgatgttagcatgatcaaaacagaggccaggtatgtaagaaatgcaacaggagttttttcaaataatgtcgcaataaggaaatggctagtctctgattggcatgattgcaggcctaagaagatcgttgggggacacatcaatgtaatagaagttggtgatgacctgtcactccatactgaatcatatgtttgcagcgcagattgtaccataggtgtagacaaagagactgcacaggtcaggcttcagacagataccacaaatcattttgaaattgcaggcactactgtgaagtcaggatggttcaagagcacgacatatataactcttgatcaaacttgcgaacaccttaaagtttcctgcggcccaaaatctgtacagttccatgcctgcttcaatcagcatatgtcttgcgtcagatttttacacaggacaatattgcctggctctatagccaattccatatgtcagaatatcgaaatcataattttagttacacttactctattaatctttatattgttaagcattttaagtaagacttatatatgttatttattaatgcctatattcatccccatagcatatatatacggtataatttacaataagtcgtgcaaaaaatgcaaattatgtggcttagtgtatcatccattcacagagtgtggcacacattgtgtctgtggtgcccgctatgatacttcagatagaatgaaactgcatagagcttctggattgtgccctggttataaaagcctaagagctgccagatacaccaacattgcaactcagttaaagggactaaaggcaatttccgtactagatgtccctataataacagggataccagatgatattgcgggtgctttaagatatatagaagagaaggaagatttccatgtccagctaactatagaatatgcgatgttaagcaaatactgtgactattatacccaattctcagataactcaggatacagtcagacaacatggagagtgtacttaaggtctcatgattttgaagcctgtatactatatccaaatcagcacttttgcagatgtgtaaaaaatggtgagaagtgcagcagctccaattgggactttgccaatgaaatgaaagattattactctgggaaacaaacaaagtttgacaaggacttaaatctagccctaacagctttgcatcatgccttcagggggacctcatctgcatatatagcaacaatgctctcaaaaaagtccaatgatgacttgattgcatacacaaataagataaaaacaaaattcccaggtaatgcattgttgaaggctataatagattatatagcatatatgaaaagtttgccaggtatggcaaatttcaaatatgatgagttctgggatgaattactgtacaaacccaacccagcaaaggcctcaaaccttgctagaggaaaggagtcatcttacaacttcaaactagcaatttcatcaaagtctataaaaacctgcaagaatgttaaggatgttgcctgcttatcgccaaggtcaggtgctatatatgcttcaataattgcgtgtggtgaacccaatgggccaagtgtgtataggaaaccatcaggtggtgtattccaatctagcactgatcggtctatatactgcttgctggatagccattgtctagaagaatttgaggccatcggccaggaggagctggatgcggtaaagaaatccaaatgttgggaaattgaatatcctgacgtaaagctcatccaagaaggcgatgggactaaaagctgtagaatgaaagattctgggaactgcaatgttgcaactaacagatggccagtgatacaatgtgagaatgacaaattttactactcagagcttcaaaaagattatgacaaagctcaagatattggtcactattgcttaagccctggatgtactactgtccggtaccctattaatccaaagcacatctctaactgtaattggcaagtaagcagatctagcatagcgaagatagatgtgcacaatattgaggatattgagcaatataagaaagctataactcagaaacttcaaacgagcctatctctattcaagtatgcaaaaacaaaaaacttgccgcacatcaaaccaatttataaatatataactatagaaggaacagaaactgcagaaggtatagagagtgcatacattgaatcagaagtacctgcattggctgggacatctatcggattcaaaatcaattctaaagagggcaagcacttgctagatgttatagcatatgtaaaaagtgcctcatactcttcagtgtatacaaaattgtactcaactggcccaacatcagggataaatactaaacatgatgaattgtgtactggcccatgcccagcaaatatcaatcatcaggttgggtggctgacatttgcaagagagaggacaagctcatggggatgcgaagagtttggttgcctggctgtaagtgatgggtgtgtatttggatcatgccaagatataataaaagaagaactatctgtctataggaaggagaccgaggaagtgactgatgtagaactgtgtttgacattttcagacaaaacatactgtacaaacttaaaccctgttacccctattataacagatctatttgaggtacagttcaaaactgtagagacctacagcttgcctagaattgttgctgtgcaaaaccatgagattaaaattgggcaaataaatgatttaggagtttactctaagggttgtgggaatgttcaaaaggtcaatggaactatttatggcaatggagttcccagatttgactacttatgccatttagctagcaggaaggaagtcattgttagaaaatgcttcgacaatgattaccaagcatgcaaatttcttcaaagccctgctagttacagacttgaagaagacagtggcactgtgaccataattgactacaaaaagattttaggaacaatcaagatgaaggcaattttaggagatgtcaaatataaaacatttgctgatagtgtcgatataaccgcagaagggtcatgcaccggctgtattaactgcttcgaaaatatccattgcgaattaacgttgcacaccacaattgaagccagctgcccaattaaaagctcgtgcacagtatttcatgacaggattcttgtgactccaaatgaacacaaatatgcattgaaaatggtgtgcacagaaaagccagggaacacactcacaattaaagtctgcaatactaaagttgaagcatctatggcccttgtagacgcaaagcctatcatagaactagcaccagttgatcagacagcatatataagagaaaaagatgaaaggtgtaaaacttggatgtgtagggtaagagatgaaggactgcaggtcatcttggagccatttaaaaatttatttggatcttatattgggatattttacacatttattatatctatagtagtattattggttattatctatgtactactacctatatgctttaagttaagggatacccttagaaagcatgaagatgcatataagagagagatgaaaattagatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17175 - RNA, 1090 nt, synthetic construct
  misc_feature 1..1090: note = mRNA product Design2 comprising derived and/or modified sequence from LACV(Human/78)__NC_004109.1__N (opt4)
  source 1..1090: mol_type = other RNA
ggggcgctgcctacggaggtggcagccatctccttctcggcatcaagcttaccatgagcgacctggtgttctacgacgtggccagcaccggcgccaacggcttcgaccccgacgccggctacatggacttctgcgtgaagaacgccgagctgctgaacctggccgccgtgagaatcttcttcctgaacgccgccaaggccaaggccgccctgagcagaaagcccgagagaaaggccaaccccaagttcggcgagtggcaggtggaggtgatcaacaaccacttccccggcaacagaaacaaccccatcggcaacaacgacctgaccatccacagactgagcggctacctggccagatgggtgctggaccagtacaacgagaacgacgacgagagccagcacgagctgatcagaaccaccatcatcaaccccatcgccgagagcaacggcgtgggctgggacagcggccccgagatctacctgagcttcttccccggcaccgagatgttcctggagaccttcaagttctaccccctgaccatcggcatccacagagtgaagcagggcatgatggacccccagtacctgaagaaggccctgagacagagatacggcaccctgaccgccgacaagtggatgagccagaaggtggccgccatcgccaagagcctgaaggacgtggagcagctgaagtggggcaagggcggcctgagcgacaccgccaagaccttcctgcagaagttcggcatcagactgccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17176 - RNA, 4708 nt, synthetic construct
  misc_feature 1..4708: note = mRNA product Design2 comprising derived and/or modified sequence from LACV(Human/78)__NC_004109.1__GP (opt4)
  source 1..4708: mol_type = other RNA
ggggcgctgcctacggaggtggcagccatctccttctcggcatcaagcttaccatgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17177 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (opt4)
  source 1..4723: mol_type = other RNA
ggggcgctgcctacggaggtggcagccatctccttctcggcatcaagcttaccatggactggacctggatcctgttcctcgtggccgctgcaacaagagtccacagcagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagagtgatgtgcaagagcaagggccccgccagcatcctgagcatcatcaccgccgtgctggtgctgaccttcgtgacccccatcaacagcatggtgctgggcgagagcaaggagaccttcgagctggaggacctgcccgacgacatgctggagatggccagcagaatcaacagctactacctgacctgcatcctgaactacgccgtgagctggggcctggtgatcatcggcctgctgatcggcctgctgttcaagaagtaccagcacagattcctgaacgtgtacgccatgtactgcgaggagtgcgacatgtaccacgacaagagcggcctgaagagacacggcgacttcaccaacaagtgcagacagtgcacctgcggccagtacgaggacgccgccggcctgatggcccacagaaagacctacaactgcctggtgcagtacaaggccaagtggatgatgaacttcctgatcatctacatcttcctgatcctgatcaaggacagcgccatcgtggtgcaggccgccggcaccgacttcaccacctgcctggagaccgagagcatcaactggaactgcaccggccccttcctgaacctgggcaactgccagaagcagcagaagaaggagccctacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17178 - RNA, 4078 nt, synthetic construct
  misc_feature 1..4078: note = mRNA product Design2 comprising derived and/or modified sequence from LACV(Human/78)__NC_004109.1__SP-GP_Gn-4aa-Gc (opt4)
  source 1..4078: mol_type = other RNA
ggggcgctgcctacggaggtggcagccatctccttctcggcatcaagcttaccatgatctgcatcctggtgctgatcaccgtggccgccgccagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagatacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17179 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (opt4)
  source 1..4093: mol_type = other RNA
ggggcgctgcctacggaggtggcagccatctccttctcggcatcaagcttaccatggactggacctggatcctgttcctcgtggccgctgcaacaagagtccacagcagccccgtgtaccagagatgcttccaggacggcgccatcgtgaagcagaaccccagcaaggaggccgtgaccgaggtgtgcctgaaggacgacgtgagcatgatcaagaccgaggccagatacgtgagaaacgccaccggcgtgttcagcaacaacgtggccatcagaaagtggctggtgagcgactggcacgactgcagacccaagaagatcgtgggcggccacatcaacgtgatcgaggtgggcgacgacctgagcctgcacaccgagagctacgtgtgcagcgccgactgcaccatcggcgtggacaaggagaccgcccaggtgagactgcagaccgacaccaccaaccacttcgagatcgccggcaccaccgtgaagagcggctggttcaagagcaccacctacatcaccctggaccagacctgcgagcacctgaaggtgagctgcggccccaagagcgtgcagttccacgcctgcttcaaccagcacatgagctgcgtgagattcctgcacagaaccatcctgcccggcagcatcgccaacagcatctgccagaacatcgagatcatcatcctggtgaccctgaccctgctgatcttcatcctgctgagcatcctgagcaagacctacatctgctacctgctgatgcccatcttcatccccatcgcctacatctacggcatcatctacaacaagagctgcaagaagtgcaagctgtgcggcctggtgtaccaccccttcaccgagtgcggcacccactgcgtgtgcggcgccagatacgacaccagcgacagaatgaagctgcacagagccagcggcctgtgccccggctacaagagcctgagagccgccagatacaccaacatcgccacccagctgaagggcctgaaggccatcagcgtgctggacgtgcccatcatcaccggcatccccgacgacatcgccggcgccctgagatacatcgaggagaaggaggacttccacgtgcagctgaccatcgagtacgccatgctgagcaagtactgcgactactacacccagttcagcgacaacagcggctacagccagaccacctggagagtgtacctgagaagccacgacttcgaggcctgcatcctgtaccccaaccagcacttctgcagatgcgtgaagaacggcgagaagtgcagcagcagcaactgggacttcgccaacgagatgaaggactactacagcggcaagcagaccaagttcgacaaggacctgaacctggccctgaccgccctgcaccacgccttcagaggcaccagcagcgcctacatcgccaccatgctgagcaagaagagcaacgacgacctgatcgcctacaccaacaagatcaagaccaagttccccggcaacgccctgctgaaggccatcatcgactacatcgcctacatgaagagcctgcccggcatggccaacttcaagtacgacgagttctgggacgagctgctgtacaagcccaaccccgccaaggccagcaacctggccagaggcaaggagagcagctacaacttcaagctggccatcagcagcaagagcatcaagacctgcaagaacgtgaaggacgtggcctgcctgagccccagaagcggcgccatctacgccagcatcatcgcctgcggcgagcccaacggccccagcgtgtacagaaagcccagcggcggcgtgttccagagcagcaccgacagaagcatctactgcctgctggacagccactgcctggaggagttcgaggccatcggccaggaggagctggacgccgtgaagaagagcaagtgctgggagatcgagtaccccgacgtgaagctgatccaggagggcgacggcaccaagagctgcagaatgaaggacagcggcaactgcaacgtggccaccaacagatggcccgtgatccagtgcgagaacgacaagttctactacagcgagctgcagaaggactacgacaaggcccaggacatcggccactactgcctgagccccggctgcaccaccgtgagataccccatcaaccccaagcacatcagcaactgcaactggcaggtgagcagaagcagcatcgccaagatcgacgtgcacaacatcgaggacatcgagcagtacaagaaggccatcacccagaagctgcagaccagcctgagcctgttcaagtacgccaagaccaagaacctgccccacatcaagcccatctacaagtacatcaccatcgagggcaccgagaccgccgagggcatcgagagcgcctacatcgagagcgaggtgcccgccctggccggcaccagcatcggcttcaagatcaacagcaaggagggcaagcacctgctggacgtgatcgcctacgtgaagagcgccagctacagcagcgtgtacaccaagctgtacagcaccggccccaccagcggcatcaacaccaagcacgacgagctgtgcaccggcccctgccccgccaacatcaaccaccaggtgggctggctgaccttcgccagagagagaaccagcagctggggctgcgaggagttcggctgcctggccgtgagcgacggctgcgtgttcggcagctgccaggacatcatcaaggaggagctgagcgtgtacagaaaggagaccgaggaggtgaccgacgtggagctgtgcctgaccttcagcgacaagacctactgcaccaacctgaaccccgtgacccccatcatcaccgacctgttcgaggtgcagttcaagaccgtggagacctacagcctgcccagaatcgtggccgtgcagaaccacgagatcaagatcggccagatcaacgacctgggcgtgtacagcaagggctgcggcaacgtgcagaaggtgaacggcaccatctacggcaacggcgtgcccagattcgactacctgtgccacctggccagcagaaaggaggtgatcgtgagaaagtgcttcgacaacgactaccaggcctgcaagttcctgcagagccccgccagctacagactggaggaggacagcggcaccgtgaccatcatcgactacaagaagatcctgggcaccatcaagatgaaggccatcctgggcgacgtgaagtacaagaccttcgccgacagcgtggacatcaccgccgagggcagctgcaccggctgcatcaactgcttcgagaacatccactgcgagctgaccctgcacaccaccatcgaggccagctgccccatcaagagcagctgcaccgtgttccacgacagaatcctggtgacccccaacgagcacaagtacgccctgaagatggtgtgcaccgagaagcccggcaacaccctgaccatcaaggtgtgcaacaccaaggtggaggccagcatggccctggtggacgccaagcccatcatcgagctggcccccgtggaccagaccgcctacatcagagagaaggacgagagatgcaagacctggatgtgcagagtgagagacgagggcctgcaggtgatcctggagcccttcaagaacctgttcggcagctacatcggcatcttctacaccttcatcatcagcatcgtggtgctgctggtgatcatctacgtgctgctgcccatctgcttcaagctgagagacaccctgagaaagcacgaggacgcctacaagagagagatgaagatcagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17180 - RNA, 1090 nt, synthetic construct
  misc_feature 1..1090: note = mRNA product Design2 comprising derived and/or modified sequence from LACV(Human/78)__NC_004109.1__N (opt3)
  source 1..1090: mol_type = other RNA
ggggcgctgcctacggaggtggcagccatctccttctcggcatcaagcttaccatgagcgacctggtgttctacgatgtcgcctccaccggcgctaacgggtttgaccccgatgcaggatatatggacttctgcgttaagaatgccgagctccttaacctggcggctgtgagaatctttttcttgaatgccgcaaaagccaaggctgcattatctaggaaacctgaacggaaggccaacccaaaatttggtgagtggcaggtagaagtgattaataaccacttcccgggcaatcgcaacaatcccatagggaacaatgatctgacaatccatcgactatcaggatacctcgctcgttgggtcctggaccaatataacgagaatgatgacgaaagtcagcacgagcttattagaactacgatcattaaccctatcgccgagagcaatggcgtgggttgggattccgggccagaaatatacctgtcgtttttccccggaaccgagatgtttttggaaacattcaagttttatcctctcactatcggcattcatagggttaagcagggcatgatggacccacagtacctgaaaaaggcgctgcggcaacgctatgggaccctcacagcagataaatggatgtctcagaaggtggccgctatcgccaaatcattaaaggacgtcgagcagctgaagtggggaaaaggtggccttagcgataccgcaaagactttcttgcagaaatttgggattagactgccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17181 - RNA, 4708 nt, synthetic construct
  misc_feature 1..4708: note = mRNA product Design2 comprising derived and/or modified sequence from LACV(Human/78)__NC_004109.1__GP (opt3)
  source 1..4708: mol_type = other RNA
ggggcgctgcctacggaggtggcagccatctccttctcggcatcaagcttaccatgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17182 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (opt3)
  source 1..4723: mol_type = other RNA
ggggcgctgcctacggaggtggcagccatctccttctcggcatcaagcttaccatggactggacctggatcctgttcctcgtggccgctgcaacaagagtccacagcagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcgggtgatgtgcaaatcaaagggcccagccagcattcttagtatcattacagcagttctggtgttgaccttcgtcactcccataaactctatggtgctcggggaatccaaagagacatttgagctggaagatttacctgacgacatgctggagatggctagccgcatcaattcgtattacctcacctgtattcttaactatgccgtatcttggggactggttatcatcggcttgctaattggtctgctctttaagaagtaccaacaccgatttctgaatgtgtatgcgatgtactgcgaagagtgtgatatgtaccacgacaaatccgggcttaagagacatggagatttcacgaacaaatgcaggcagtgtacctgcggccagtatgaagacgccgcaggcctgatggctcaccggaagacatacaattgcttggtccagtataaagccaagtggatgatgaacttcctcataatctacatttttctgatcttaattaaggattcagctatcgtggtccaagccgcagggactgacttcaccacatgtctggagactgagagtataaactggaattgcaccggaccatttctaaacctcggtaattgtcagaaacagcaaaagaaagaaccgtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17183 - RNA, 4078 nt, synthetic construct
  misc_feature 1..4078: note = mRNA product Design2 comprising derived and/or modified sequence from LACV(Human/78)__NC_004109.1__SP-GP_Gn-4aa-Gc (opt3)
  source 1..4078: mol_type = other RNA
ggggcgctgcctacggaggtggcagccatctccttctcggcatcaagcttaccatgatctgcattctggtgctcataaccgtcgccgctgcaagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcggtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17184 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (opt3)
  source 1..4093: mol_type = other RNA
ggggcgctgcctacggaggtggcagccatctccttctcggcatcaagcttaccatggactggacctggatcctgttcctcgtggccgctgcaacaagagtccacagcagccccgtttaccagagatgtttccaagacggcgccatcgtgaagcagaacccttccaaagaggcggtaacagaagtgtgccttaaggatgacgtctctatgattaaaactgaggctaggtatgtgcggaatgccacgggggttttctcaaacaatgtggcaatccgcaagtggctggtcagtgattggcacgactgtcgaccgaaaaagattgtgggaggtcatatcaacgtaatagaagttggcgatgacttgagcttacacaccgagtcctacgtgtgctctgccgattgtacaatcggggtcgacaaggaaactgctcaggtgcgtctgcagaccgatacaaccaatcatttcgagattgcaggaactacagtgaaatcgggctggtttaagtcaaccacgtatatcactctagaccaaacctgcgagcacctcaaagtcagctgtggtccaaagagtgttcagttccatgcctgctttaaccagcacatgtcctgtgtgagattcctgcacaggacaattcttcccgggtctatcgctaatagcatatgccagaacattgaaatcattatcctggtaactttgaccctcctgatctttattctgctctccatattatcaaaaacatacatctgttatctgcttatgcctattttcatcccaatagcctacatttatggaatcatctacaataagagttgcaagaaatgcaagttgtgtggcctggtgtaccatccctttaccgagtgcggcacgcactgtgtctgcggggcgcggtatgatactagcgaccgcatgaaactacatagagcatctggactctgtcctggttacaagtccctgagggccgctcggtatacaaacatcgccacccagctgaagggccttaaagctattagcgtgttggatgttcccatcattactgggatccctgacgatatagcgggagcactgcgttacattgaggaaaaggaggacttccatgtgcagctcacgatcgaatatgccatgctgtccaagtactgcgattactatacacagttttctgacaatagcggctactcacaaaccacttggcgcgtatatcttagaagtcacgacttcgaggcttgtattctgtacccaaaccagcatttttgtaggtgcgtcaaaaatggtgagaagtgctccagctctaactgggatttcgccaatgaaatgaaagactattactcagggaagcagaccaaatttgataaggacttgaacctcgcactgacagccttacaccacgctttccggggcaccagtagcgcctatatcgcaactatgctgtccaagaaatctaatgatgacctaatagcgtacacaaacaagatcaaaacgaagtttcccggaaatgctctcctgaaagccattatcgattacattgcatatatgaagtcgcttcctggcatggccaacttcaaatacgacgagttttgggatgaattgctgtataagccaaatcccgctaaggccagcaacctcgcacgagggaaagagtcctcatacaacttcaagctggctatcagttctaaaagcataaagacctgtaaaaatgtgaaggacgttgcctgcttatccccgcgctcaggagcgatttatgccagcatcatcgcttgtggtgaacctaacggcccctctgtgtacagaaagccatccgggggagtcttccagagtagcactgataggtctatttattgcctgcttgactcccattgcttggaggagtttgaagcaatcggccaagaggaactcgatgccgtgaaaaagtcaaaatgttgggagattgagtaccctgacgtaaagctgatacaggaaggtgacgggacaaaaagttgccggatgaaggatagcggcaattgtaacgtggctaccaatcgctggcccgttatccagtgcgagaacgacaagttctactattcggaactacagaaagattacgacaaggcccaagatattggacactattgtctgtccccaggctgcacaactgtcagataccccatcaatcctaaacatatttctaactgtaattggcaagtgagcaggtcaagtatcgcaaagatagacgtgcacaacatcgaggatattgaacagtataaaaaggcgatcacccagaagctccaaacgtccctgtctctttttaaatacgccaagaccaaaaatttgccacacattaagccgatctataaatacataacaattgaggggactgagaccgctgaaggaatcgagagcgcctacatcgaatccgaggtccccgcactggctggtacatcaattggcttcaagataaacagcaaagaagggaagcatttactcgacgttatcgcctatgtgaagagtgcatcttactccagcgtgtatactaaactgtactcgaccggacctacgtcaggcattaatacaaagcacgatgagctttgcaccggtccatgtcccgccaacatcaatcatcaggtagggtggctgacttttgctcgtgagcggacatctagttggggctgcgaagagttcggatgtttggcggtctccgacggctgcgtgtttgggagctgccaggatattatcaaagaggaactctctgtttatcgaaaggaaaccgaggaggtgactgacgtcgaactgtgtctaaccttcagcgataaaacatactgcacgaacctgaaccctgtgaccccaataatcactgacctctttgaggttcaattcaagacagtggaaacctattccctgcccagaattgtagccgtccagaatcacgagatcaagattggacagatcaacgaccttggcgtgtactcaaaaggttgtgggaatgtgcagaaggtcaacggaacaatatacggcaatggtgttccgaggtttgattatttgtgccatctggcaagtcgcaaagaggtgattgtacggaagtgtttcgacaacgattaccaggcttgcaaatttttacagagccctgcctcttatagactcgaagaggactccggcactgtgaccatcatcgattacaagaagattctggggacgatcaaaatgaaggccatacttggagacgtcaaatataagacattcgctgattcagtggacattaccgcagaaggcagttgtactgggtgcatcaattgtttcgagaacattcactgcgaactgaccctacacacaactatcgaggccagctgtccaataaaatcctcttgcaccgtttttcatgataggattctcgtgacacccaatgagcacaagtacgcgctgaagatggtctgcacggaaaaacctggaaacaccttgactatcaaggtgtgtaatacaaaagttgaggcttcgatggccctggtggacgcaaagcccatcattgaattagccccagtcgatcagaccgcttatatccgcgagaaagacgaacgatgcaagacttggatgtgtcgggtacgtgacgagggcctccaggtgattctggagcctttcaagaacctttttggtagctacatagggatcttctacacatttattatctcaatcgttgtgctgttggtcattatatatgtgctcctgcccatctgcttcaaactaagagataccctgaggaagcatgaagacgcatacaaacgcgagatgaagattcggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17185 - RNA, 1090 nt, synthetic construct
  misc_feature 1..1090: note = mRNA product Design2 comprising derived and/or modified sequence from LACV(Human/78)__NC_004110.1__N (opt1)
  source 1..1090: mol_type = other RNA
ggggcgctgcctacggaggtggcagccatctccttctcggcatcaagcttaccatgagcgacctggtgttctacgacgtcgcctccaccggcgccaacgggttcgaccccgacgcgggctacatggacttctgcgtgaagaacgccgagctcctgaacctggccgccgtgcgcatcttcttcctcaacgccgcgaaggccaaggccgccctgagccggaagccggagcgcaaggcgaaccccaagttcggggagtggcaggtcgaggtgatcaacaaccacttccccggcaaccggaacaaccccatcgggaacaacgacctgaccatccaccgcctctccggctacctggcccggtgggtgctggaccagtacaacgagaacgacgacgagagccagcacgagctcatccgcacgaccatcatcaacccgatcgccgagtccaacggcgtcgggtgggacagcggccccgagatctacctgtccttcttccccgggaccgagatgttcctggagaccttcaagttctaccccctcacgatcggcatccaccgggtgaagcaggggatgatggacccgcagtacctgaagaaggccctgcgccagcggtacggcaccctcaccgccgacaagtggatgagccagaaggtggcggccatcgccaagtccctgaaggacgtcgagcagctgaagtggggcaagggcgggctcagcgacaccgccaagacgttcctgcagaagttcgggatccgcctgccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17186 - RNA, 4708 nt, synthetic construct
  misc_feature 1..4708: note = mRNA product Design2 comprising derived and/or modified sequence from LACV(Human/78)__NC_004109.1__GP (opt1)
  source 1..4708: mol_type = other RNA
ggggcgctgcctacggaggtggcagccatctccttctcggcatcaagcttaccatgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17187 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (opt1)
  source 1..4723: mol_type = other RNA
ggggcgctgcctacggaggtggcagccatctccttctcggcatcaagcttaccatggactggacctggatcctgttcctcgtggccgccgcgacccgcgtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17188 - RNA, 4078 nt, synthetic construct
  misc_feature 1..4078: note = mRNA product Design2 comprising derived and/or modified sequence from LACV(Human/78)__NC_004109.1__SP-GP_Gn-4aa-Gc (opt1)
  source 1..4078: mol_type = other RNA
ggggcgctgcctacggaggtggcagccatctccttctcggcatcaagcttaccatgatctgcatcctggtgctcatcaccgtcgccgccgcgagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17189 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (opt1)
  source 1..4093: mol_type = other RNA
ggggcgctgcctacggaggtggcagccatctccttctcggcatcaagcttaccatggactggacctggatcctgttcctcgtggccgccgcgacccgcgtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17190 - RNA, 1090 nt, synthetic construct
  misc_feature 1..1090: note = mRNA product Design2 comprising derived and/or modified sequence from LACV(Human/78)__NC_004109.1__N (opt5)
  source 1..1090: mol_type = other RNA
ggggcgctgcctacggaggtggcagccatctccttctcggcatcaagcttaccatgagcgacctggtgttctacgatgtcgcctccaccggcgctaacgggtttgaccccgatgccggatatatggacttctgcgttaagaatgcggagctcctgaaccttgctgccgtgagaatctttttcctgaatgccgctaaagccaaggctgccctctctcggaaacctgaacgcaaggcgaacccgaaatttggcgagtggcaagtggaagtcattaataaccacttccccgggaatagaaacaatcctatcggaaacaatgatctgacaattcatcggcttagcggctacctggcccgctgggtgctcgaccagtataacgagaatgatgacgaatcccagcacgagctgatcagaacgaccattatcaaccccatcgctgagtctaatggggttggatgggatagcggccctgaaatttacctgtcctttttccccggcacagagatgtttctcgaaaccttcaagttttatcctctgacaatcgggattcatcgggtgaagcagggaatgatggacccgcagtaccttaaaaaggccctgcgccaaagatatggcaccctcacagctgataaatggatgtctcagaaggtcgccgcgatcgccaaaagcctgaaggacgtggagcagcttaagtgggggaaaggaggcctgtccgataccgctaagacgttcctccagaaatttgggattcggctgccctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17191 - RNA, 4708 nt, synthetic construct
  misc_feature 1..4708: note = mRNA product Design2 comprising derived and/or modified sequence from LACV(Human/78)__NC_004109.1__GP (opt5)
  source 1..4708: mol_type = other RNA
ggggcgctgcctacggaggtggcagccatctccttctcggcatcaagcttaccatgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggcctcctgttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17192 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (opt5)
  source 1..4723: mol_type = other RNA
ggggcgctgcctacggaggtggcagccatctccttctcggcatcaagcttaccatggactggacctggatcctgttcctcgtggccgctgcaacaagagtccacagcagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagagtcatgtgcaaatccaagggcccggcctctatccttagcatcattacggctgtgctggttctcaccttcgtgacacccatcaactccatggtcctgggggaaagcaaagagacctttgagcttgaagatctgcctgacgacatgctcgagatggcctctcggattaattcctattacctgacatgtatcctgaactatgctgtgagctggggactcgtcattatcggcctgcttattggcctcctgttcaagaagtaccaacaccgctttctgaatgtgtatgccatgtactgcgaagagtgtgatatgtaccacgacaaatctgggcttaagagacatggagatttcaccaacaaatgccggcagtgtacgtgcggccagtatgaagacgccgctgggctgatggcgcaccgcaagacatacaattgcctcgttcagtataaagccaagtggatgatgaacttcctgatcatctacatttttctgatcctcattaaggatagcgctatcgtggtccaagccgccggaaccgacttcaccacatgtctggagaccgagtccattaactggaattgcacaggcccctttcttaacctggggaattgtcagaaacagcaaaagaaagaaccttatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17193 - RNA, 4078 nt, synthetic construct
  misc_feature 1..4078: note = mRNA product Design2 comprising derived and/or modified sequence from LACV(Human/78)__NC_004109.1__SP-GP_Gn-4aa-Gc (opt5)
  source 1..4078: mol_type = other RNA
ggggcgctgcctacggaggtggcagccatctccttctcggcatcaagcttaccatgatctgcattctggtgctcatcaccgtcgccgctgccagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagatatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17194 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (opt5)
  source 1..4093: mol_type = other RNA
ggggcgctgcctacggaggtggcagccatctccttctcggcatcaagcttaccatggactggacctggatcctgttcctcgtggccgctgcaacaagagtccacagcagccccgtttaccagagatgtttccaagacggcgcgattgtgaagcagaacccttccaaagaggctgtgacagaagtctgcctgaaggatgacgtgtctatgatcaaaacggaggcccggtatgttcgcaatgccaccggggtgtttagcaacaatgtcgctattagaaagtggcttgtgtccgattggcacgactgtcggccgaaaaagatcgttggaggccatatcaacgtgattgaagtcggggatgacctgtctctccacacagagagctacgtgtgctccgccgattgtaccatcggagtggacaaggaaacagctcaggtccgcctgcagaccgatacaaccaatcatttcgagattgccggcacgaccgttaaatctgggtggtttaagagcacaacctatatcacacttgaccaaacctgcgagcacctgaaagtgtcctgtggacccaagagcgtgcagttccatgcgtgctttaaccagcacatgtcttgtgtcagattcctccaccggacgattctgcctggctccatcgccaatagcatttgccagaacatcgaaatcattatcctggtgacactcaccctgcttatttttatcctgctctctattctgtccaaaacatacatctgttatcttctgatgcccatcttcattcctatcgcttacatttatggcatcatttacaataagagctgcaagaaatgcaagctctgtgggctggtttaccatccctttaccgagtgcggaacccactgtgtgtgcggcgcccgctatgatacatctgacagaatgaaactgcatcgggcttccgggctctgtcctggatacaagagcctgcgcgccgcgagatatacgaacatcgctacccagctcaagggactgaaagccatctctgtgctggatgttcccattatcacaggcattccggacgatatcgcgggcgctcttagatacattgaggaaaaggaggacttccatgtgcagctcaccatcgaatatgccatgctgagcaagtactgcgattactatacacagttttccgacaatagcgggtactctcaaaccacgtggcgggtctatctgagatcccacgacttcgaggcctgtatcctctaccctaaccagcatttttgccgctgtgtgaaaaatggagagaagtgctctagctccaactgggatttcgctaatgaaatgaaagactattacagcggcaagcagaccaaatttgataaggacctgaaccttgccctgacagctctccaccacgccttccgggggacctcctctgcgtatattgccacaatgctgagcaagaaatccaatgatgacctgatcgcttacaccaacaagattaaaacgaagtttcccggaaatgcccttctcaaagctatcattgattacatcgcctatatgaagtctctgcctggcatggcgaacttcaaatacgacgagttttgggatgaactgctctataagcccaatcccgccaaggctagcaacctggccagagggaaagagtccagctacaacttcaaacttgctatctcttccaaaagcattaagacatgtaaaaatgtgaaggacgttgcctgcctgtctcctcgctccggcgccatctatgctagcattatcgcgtgtggagaaccgaacggcccctctgtctaccggaagcctagcgggggagtgttccagtccagcaccgatagatctatttattgcctcctggactcccattgcctggaggagtttgaagccatcggccaagaggaacttgatgctgtgaaaaagagcaaatgttgggagattgagtaccccgacgtcaagctcatccaggaaggggacggaacaaaatcctgccgcatgaaggattctggcaattgtaacgtggccaccaatcggtggcctgttatccagtgcgagaacgacaagttctactatagcgaactgcagaaagattacgacaaggcccaagatattgggcactattgtctgtcccccggctgcaccacagtgagatacccgatcaatcctaaacatatttctaactgtaattggcaggtcagccgctcctctatcgctaagattgacgtgcacaacatcgaggatatcgaacagtataaaaaggccattacgcagaagctccaaaccagcctgtccctttttaaatacgcgaagacaaagaatctgccccacatcaagcctatttataaatacatcaccattgagggaacagagaccgctgaaggcatcgagagcgcctacatcgaatctgaggttcccgccctcgctgggacgtccattggattcaagatcaacagcaaagaaggcaagcatctgctggacgtgattgcctatgtcaagtctgcgtcctacagctctgtgtatacaaaactttactccaccgggcctaccagcggaatcaatacaaagcacgatgagctctgcaccggcccctgtccggctaacattaatcatcaggttgggtggctgacatttgcccgggagagaacgtccagctggggctgcgaagagttcggatgtctggccgtgtctgacggctgcgtctttgggagctgccaggatatcattaaagaggaactctccgtgtatcgcaaggaaaccgaggaggtgacagacgtcgaactgtgtcttaccttctctgataaaacatactgcaccaacctgaaccctgttacgcccatcatcaccgacctctttgaggtgcaattcaagacagtggaaacctatagcctgccccggattgtcgctgtgcagaatcacgagatcaagattggacagatcaacgacctgggcgtttactccaaagggtgtggaaatgtgcagaaggtcaacggcacaatttacgggaatggcgtgcctagatttgattatctttgccatctggcctctcggaaagaggttatcgtgcgcaagtgtttcgacaacgattaccaggcttgcaaatttctccaaagcccggcctcctatagactggaagaggactctggaaccgtcacaatcattgattacaagaagatcctcggcaccattaaaatgaaggcgatcctgggggacgtgaaatataagacgttcgccgatagcgttgacattacagctgaaggatcctgtaccggctgcatcaattgtttcgagaacatccactgcgaacttaccctgcacacaaccattgaggccagctgtcccatcaaatcttcctgcacggtgtttcatgatcggattctcgtcacacctaatgagcacaagtacgctctgaagatggtgtgcaccgaaaaacccgggaacacactgaccatcaaggtgtgtaatacaaaagtcgaggccagcatggcccttgttgacgctaagcctattatcgaactggcgcccgtggatcagaccgcctatattagagagaaagacgaacgctgcaagacgtggatgtgtcgggtgagagacgagggactccaggtcatcctggagcctttcaagaacctctttggctcttacatcggcattttctacacctttatcatttccatcgtggttctgcttgtgattatctatgtcctgctccccatctgcttcaaactgcgcgatacactgagaaagcatgaagacgcttacaaacgggagatgaagattcgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17195 - RNA, 1090 nt, synthetic construct
  misc_feature 1..1090: note = mRNA product Design2 comprising derived and/or modified sequence from LACV(Human/78)__NC_004109.1__N (opt11)
  source 1..1090: mol_type = other RNA
ggggcgctgcctacggaggtggcagccatctccttctcggcatcaagcttaccatgtccgacctcgtattctacgacgtagcctcaacaggcgccaacggattcgacccagacgccggatacatggacttctgcgtcaaaaacgccgaactcctcaacctcgccgccgtccgcatcttcttcctcaacgccgccaaagccaaagcagccctatcccgcaaacccgaacgaaaagccaaccccaaattcggcgaatggcaagtcgaagtcatcaacaaccacttccccggcaaccgcaacaacccaatcggcaacaacgacctcaccatacaccgactttccggctacctcgcccgatgggtcctcgaccaatacaacgaaaacgacgacgaatcccaacacgaactaatacgcacaaccatcatcaaccccatcgccgagtccaacggcgtcggctgggactccggacccgaaatatacctctccttcttccccggcacagaaatgttcctagaaaccttcaaattctacccactcactatcggcatccacagagtaaaacaaggaatgatggacccccaatacctcaaaaaagccctacgacaacgctacggaacccttaccgccgacaaatggatgtcacaaaaagtcgccgccatcgccaaatccctcaaagacgtagaacaactcaaatggggaaaaggcggcctctcagacaccgccaaaaccttcctccaaaaattcggcatccgactcccataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17196 - RNA, 4708 nt, synthetic construct; identical to SEQ ID NO: 17186
  misc_feature 1..4708: note = mRNA product Design2 comprising derived and/or modified sequence from LACV(Human/78)__NC_004109.1__GP (opt11)
  source 1..4708: mol_type = other RNA

SEQ ID NO: 17197 - RNA, 4723 nt, synthetic construct
  misc_feature 1..4723: note = mRNA product Design2 comprising derived and/or modified sequence from LACV(Human/78)__NC_004109.1__IgE-leader_Gn-NSm-Gc (opt11)
  source 1..4723: mol_type = other RNA
ggggcgctgcctacggaggtggcagccatctccttctcggcatcaagcttaccatggactggacctggatcctgttcctcgtggccgctgcaacaagagtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgcgtgatgtgcaagagcaagggcccggcctccatcctcagcatcatcaccgccgtcctggtgctgaccttcgtcacccccatcaactccatggtgctcggggagagcaaggagacgttcgagctggaggacctgcccgacgacatgctcgagatggcctcccggatcaacagctactacctgacctgcatcctgaactacgcggtgtcctggggcctcgtcatcatcggcctgctgatcgggctcctgttcaagaagtaccagcaccgcttcctgaacgtgtacgccatgtactgcgaggagtgcgacatgtaccacgacaagagcggcctcaagcggcacggggacttcaccaacaagtgccgccagtgcacgtgcggccagtacgaggacgccgccgggctgatggcccaccggaagacgtacaactgcctggtgcagtacaaggcgaagtggatgatgaacttcctcatcatctacatcttcctgatcctgatcaaggactccgccatcgtcgtgcaggccgccggcaccgacttcacgacctgcctcgagaccgagagcatcaactggaactgcaccggccccttcctgaacctggggaactgccagaagcagcagaagaaggagccgtacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17198 - RNA, 4078 nt, synthetic construct; identical to SEQ ID NO: 17188
  misc_feature 1..4078: note = mRNA product Design2 comprising derived and/or modified sequence from LACV(Human/78)__NC_004109.1__SP-GP_Gn-4aa-Gc (opt11)
  source 1..4078: mol_type = other RNA

SEQ ID NO: 17199 - RNA, 4093 nt, synthetic construct
  misc_feature 1..4093: note = mRNA product Design2 comprising derived and/or modified sequence from LACV(Human/78)__NC_004109.1__IgE-leader_Gn-4aa-Gc (opt11)
  source 1..4093: mol_type = other RNA
ggggcgctgcctacggaggtggcagccatctccttctcggcatcaagcttaccatggactggacctggatcctgttcctcgtggccgctgcaacaagagtccacagcagccccgtgtaccagcgctgcttccaggacggcgccatcgtgaagcagaacccgtccaaggaggccgtcaccgaggtgtgcctgaaggacgacgtgagcatgatcaagacggaggcccggtacgtccgcaacgccaccggggtgttctccaacaacgtggcgatccggaagtggctggtcagcgactggcacgactgccgccccaagaagatcgtgggcgggcacatcaacgtgatcgaggtcggcgacgacctctccctgcacaccgagagctacgtgtgctccgccgactgcaccatcggggtggacaaggagacggcccaggtccggctgcagaccgacaccaccaaccacttcgagatcgccggcacgaccgtcaagagcggctggttcaagtccaccacctacatcacgctcgaccagacctgcgagcacctgaaggtgagctgcgggcccaagtccgtgcagttccacgcgtgcttcaaccagcacatgagctgcgtgcgcttcctgcaccggaccatcctccccggctccatcgccaacagcatctgccagaacatcgagatcatcatcctggtgaccctgacgctcctgatcttcatcctgctctccatcctgagcaagacctacatctgctacctgctcatgccgatcttcatccccatcgcctacatctacgggatcatctacaacaagtcctgcaagaagtgcaagctgtgcggcctggtctaccaccccttcaccgagtgcgggacccactgcgtgtgcggcgcccgctacgacacgagcgaccggatgaagctccaccgcgcctccggcctgtgccccgggtacaagagcctgcgggcggcccgctacaccaacatcgccacccagctcaagggcctgaaggcgatctccgtgctggacgtccccatcatcacggggatccccgacgacatcgccggcgccctgcgctacatcgaggagaaggaggacttccacgtgcagctcaccatcgagtacgccatgctgagcaagtactgcgactactacacccagttctccgacaacagcgggtactcccagaccacctggcgggtgtacctgcgcagccacgacttcgaggcgtgcatcctctaccccaaccagcacttctgccggtgcgtcaagaacggcgagaagtgctccagctccaactgggacttcgccaacgagatgaaggactactacagcggcaagcagacgaagttcgacaaggacctgaacctggccctcaccgccctgcaccacgccttccgcgggaccagctccgcgtacatcgccaccatgctgagcaagaagtccaacgacgacctcatcgcctacacgaacaagatcaagaccaagttcccgggcaacgccctgctgaaggccatcatcgactacatcgcgtacatgaagtccctccccgggatggccaacttcaagtacgacgagttctgggacgagctgctgtacaagcccaaccccgccaaggccagcaacctcgcccgcggcaaggagagctcctacaacttcaagctggcgatcagctccaagagcatcaagacctgcaagaacgtgaaggacgtggcctgcctgtccccgcggagcggggccatctacgcctccatcatcgcgtgcggcgagcccaacggccccagcgtctaccgcaagccctccgggggcgtgttccagagctccaccgaccggagcatctactgcctcctggacagccactgcctggaggagttcgaggccatcgggcaggaggagctcgacgccgtgaagaagtccaagtgctgggagatcgagtacccggacgtcaagctgatccaggagggcgacggcaccaagagctgccgcatgaaggactccgggaactgcaacgtggccaccaaccggtggcccgtgatccagtgcgagaacgacaagttctactacagcgagctgcagaaggactacgacaaggcccaggacatcggccactactgcctctcccccgggtgcaccaccgtccgctaccccatcaacccgaagcacatcagcaactgcaactggcaggtctcccggagctccatcgcgaagatcgacgtgcacaacatcgaggacatcgagcagtacaagaaggccatcacgcagaagctgcagaccagcctgtccctcttcaagtacgccaagaccaagaacctgccccacatcaagcccatctacaagtacatcaccatcgagggcacggagaccgccgaggggatcgagagcgcctacatcgagtccgaggtgccggcgctggccggcaccagcatcggcttcaagatcaactccaaggaggggaagcacctcctggacgtgatcgcctacgtcaagagcgcctcctacagctccgtgtacaccaagctgtacagcacgggccccaccagcgggatcaacaccaagcacgacgagctctgcaccggcccctgccccgccaacatcaaccaccaggtggggtggctgacgttcgcgcgcgagcggacctccagctggggctgcgaggagttcggctgcctggccgtgtccgacgggtgcgtcttcggcagctgccaggacatcatcaaggaggagctctccgtgtaccgcaaggagaccgaggaggtgaccgacgtcgagctgtgcctgacgttcagcgacaagacctactgcaccaacctcaacccggtgacccccatcatcacggacctgttcgaggtgcagttcaagaccgtcgagacctactccctgccccggatcgtggccgtgcagaaccacgagatcaagatcgggcagatcaacgacctcggcgtctacagcaaggggtgcggcaacgtgcagaaggtgaacggcaccatctacgggaacggcgtcccccgcttcgactacctgtgccacctggcctcccggaaggaggtgatcgtgcgcaagtgcttcgacaacgactaccaggcgtgcaagttcctccagagcccggcctcctaccggctggaggaggacagcgggacggtcaccatcatcgactacaagaagatcctgggcaccatcaagatgaaggccatcctcggggacgtgaagtacaagaccttcgccgactccgtggacatcaccgccgagggcagctgcacgggctgcatcaactgcttcgagaacatccactgcgagctgaccctgcacaccaccatcgaggcgtcctgccccatcaagagctcctgcacggtcttccacgaccgcatcctcgtgacccccaacgagcacaagtacgccctgaagatggtgtgcaccgagaagcccgggaacaccctgacgatcaaggtctgcaacaccaaggtggaggccagcatggccctcgtcgacgccaagccgatcatcgagctggcgcccgtggaccagaccgcctacatccgggagaaggacgagcgctgcaagacctggatgtgccgggtgcgcgacgagggcctgcaggtcatcctcgagcccttcaagaacctgttcgggtcctacatcggcatcttctacacgttcatcatcagcatcgtggtgctgctcgtcatcatctacgtgctgctgcccatctgcttcaagctccgcgacaccctgcggaagcacgaggacgcctacaagcgcgagatgaagatccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17200 - protein, 245 aa, synthetic construct; identical to SEQ ID NO: 853
  REGION 1..245: note = derived and/or modified protein sequence (wt) from RVFV(ZH-548)__DQ380151.1__N

SEQ ID NO: 17201 - protein, 1197 aa, synthetic construct; identical to SEQ ID NO: 2009
  REGION 1..1197: note = derived and/or modified protein sequence (wt) from RVFV(ZH-548)__DQ380206.1__GP

SEQ ID NO: 17202 - protein, 1067 aa, synthetic construct; identical to SEQ ID NO: 2159
  REGION 1..1067: note = derived and/or modified protein sequence (wt) from RVFV(ZH-548)__DQ380206.1__Gn-Gc

SEQ ID NO: 17203 - protein, 984 aa, synthetic construct
  REGION 1..984: note = derived and/or modified protein sequence (wt) from RVFV(ZH-548)__DQ380206.1__Gne_SP-Gn_Gc
MAGIAMTVLPALAVFALAPVVFAEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTAMAGIAMTVLPALAVFALAPVVFAEDCSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17204 - protein, 1062 aa, synthetic construct
  REGION 1..1062: note = derived and/or modified protein sequence (wt) from RVFV(ZH-548)__DQ380206.1__IgE-leader_Gn(delSP)-Gc-variant1
MDWTWILFLVAAATRVHSEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17205 - protein, 1060 aa, synthetic construct
  REGION 1..1060: note = derived and/or modified protein sequence (wt) from RVFV(ZH-548)__DQ380206.1__IgE-leader_Gn(delSP)-Gc-variant2
MDWTWILFLVAAATRVHSPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASACSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17206 - protein, 555 aa, synthetic construct
  REGION 1..555: note = derived and/or modified protein sequence (wt) from RVFV(ZH-548)__DQ380206.1__IgE-leader_Gn(delSP)-variant1
MDWTWILFLVAAATRVHSEDPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 17207 - protein, 553 aa, synthetic construct
  REGION 1..553: note = derived and/or modified protein sequence (wt) from RVFV(ZH-548)__DQ380206.1__IgE-leader_Gn(delSP)-variant2
MDWTWILFLVAAATRVHSPHLRNRPGKGHNYIDGMTQEDATCKPVTYAGACSSFDVLLEKGKFPLFQSYAHHRTLLEAVHDTIIAKADPPSCDLLSAHGNPCMKEKLVMKTHCPNDYQSAHYLNNDGKMASVKCPPKYELTEDCNFCRQMTGASLKKGSYPLQDLFCQSSEDDGSKLKTKMKGVCEVGVQALKKCDGQLSTAHEVVPFAVFKNSKKVYLDKLDLKTEENLLPDSFVCFEHKGQYKGTMDSGQTKRELKSFDISQCPKIGGHGSKKCTGDAAFCSAYECTAQYANAYCSHANGSGIVQIQVSGVWKKPLCVGYERVVVKRELSAKPIQRVEPCTTCITKCEPHGLVVRSTGFKISSAVACASGVCVTGSQSPSTEITLKYPGISQSSGGDIGVHMAHDDQSVSSKIVAHCPPQDPCLVHDCIVCAHGLINYQCHTALSAFVVVFVFSSIAIICLAILYRVLKCLKIAPRKVLNPLMWITAFIRWIYKKMVARVADNINQVNREIGWMEGGQLVLGNPAPIPRHAPIPRYSTYLMLLLIVSYASA

SEQ ID NO: 17208 - protein, 525 aa, synthetic construct
  REGION 1..525: note = derived and/or modified protein sequence (wt) from RVFV(ZH-548)__DQ380206.1__IgE-leader_Gc
MDWTWILFLVAAATRVHSCSELIQASSRITTCSTEGVNTKCRLSGTALIRAGSVGAEACLMLKGVKEDQTKFLKIKTVSSELSCREGQSYWTGSFSPKCLSSRRCHLVGECHVNRCLSWRDNETSAEFSFVGESTTMRENKCFEQCGGWGCGCFNVNPSCLFVHTYLQSVRKEALRVFNCIDWVHKLTLEITDFDGSVSTIDLGASSSRFTNWGSVSLSLDAEGISGSNSFSFIESPGKGYAIVDEPFSEIPRQGFLGEIRCNSESSVLSAHESCLRAPNLISYKPMIDQLECTTNLIDPFVVFERGSLPQTRNDKTFAASKGNRGVQAFSKGSVQADLTLMFDNFEVDFVGAAVSCDAAFLNLTGCYSCNAGARVCLSITSTGTGSLSAHNKDGSLHIVLPSENGTKDQCQILHFTVPEVEEEFMYSCDGDERPLLVKGTLIAIDPFDDRREAGGESTVVNPKSGSWNFFDWFSGLMSWFGGPLKTILLICLYVALSIGLFFLLIYLGRTGLSKMWLAATKKAS

SEQ ID NO: 17209 - RNA, 738 nt, synthetic construct; identical to SEQ ID NO: 3188
  misc_feature 1..738: note = derived and/or modified CDS sequence (wt) from RVFV(ZH-548)__DQ380151.1__N
  source 1..738: mol_type = other RNA

SEQ ID NO: 17210 - RNA, 738 nt, synthetic construct
  misc_feature 1..738: note = derived and/or modified CDS sequence (wt) from RVFV(ZH-548)__DQ380151.1__N
  source 1..738: mol_type = other RNA
atggacaactatcaagagcttgcgatccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagagttcttgaaagcctttggacttgtggattccaatgggaagccgtcagctgctgtcatggcagccgctcaggcttacaagacagcagcctaa

SEQ ID NO: 17211 - RNA, 3594 nt, synthetic construct; identical to SEQ ID NO: 4344
  misc_feature 1..3594: note = derived and/or modified CDS sequence (wt) from RVFV(ZH-548)__DQ380206.1__GP
  source 1..3594: mol_type = other RNA

SEQ ID NO: 17212 - RNA, 3594 nt, synthetic construct
  misc_feature 1..3594: note = derived and/or modified CDS sequence (wt) from RVFV(ZH-548)__DQ380206.1__GP
  source 1..3594: mol_type = other RNA
atgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgtcatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17213 - RNA, 3204 nt, synthetic construct; identical to SEQ ID NO: 4494
  misc_feature 1..3204: note = derived and/or modified CDS sequence (wt) from RVFV(ZH-548)__DQ380206.1__Gn-Gc
  source 1..3204: mol_type = other RNA

SEQ ID NO: 17214 - RNA, 3204 nt, synthetic construct
  misc_feature 1..3204: note = derived and/or modified CDS sequence (wt) from RVFV(ZH-548)__DQ380206.1__Gn-Gc
  source 1..3204: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17215 - RNA, 2955 nt, synthetic construct
  misc_feature 1..2955: note = derived and/or modified CDS sequence (wt) from RVFV(ZH-548)__DQ380206.1__Gne_SP-Gn_Gc
  source 1..2955: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctatggcagggattgcaatgacagtccttccagccttagcagtttttgctttggcacctgttgtttttgctgaagactgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17216 - RNA, 2955 nt, synthetic construct
  misc_feature 1..2955: note = derived and/or modified CDS sequence (wt) from RVFV(ZH-548)__DQ380206.1__Gne_SP-Gn_Gc
  source 1..2955: mol_type = other RNA
atggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctatggcagggattgcaatgacagtccttccagccttagcagtttttgctttggcacctgttgtttttgctgaagactgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17217 - RNA, 3189 nt, synthetic construct
  misc_feature 1..3189: note = derived and/or modified CDS sequence (wt) from RVFV(ZH-548)__DQ380206.1__IgE-leader_Gn(delSP)-Gc-variant1
  source 1..3189: mol_type = other RNA
atggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17218 - RNA, 3189 nt, synthetic construct
  misc_feature 1..3189: note = derived and/or modified CDS sequence (wt) from RVFV(ZH-548)__DQ380206.1__IgE-leader_Gn(delSP)-Gc-variant1
  source 1..3189: mol_type = other RNA
atggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17219 - RNA, 3183 nt, synthetic construct
  misc_feature 1..3183: note = derived and/or modified CDS sequence (wt) from RVFV(ZH-548)__DQ380206.1__IgE-leader_Gn(delSP)-Gc-variant2
  source 1..3183: mol_type = other RNA
atggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17220 - RNA, 3183 nt, synthetic construct
  misc_feature 1..3183: note = derived and/or modified CDS sequence (wt) from RVFV(ZH-548)__DQ380206.1__IgE-leader_Gn(delSP)-Gc-variant2
  source 1..3183: mol_type = other RNA
atggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17221 - RNA, 1668 nt, synthetic construct
  misc_feature 1..1668: note = derived and/or modified CDS sequence (wt) from RVFV(ZH-548)__DQ380206.1__IgE-leader_Gn(delSP)-variant1
  source 1..1668: mol_type = other RNA
atggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatag

SEQ ID NO: 17222 - RNA, 1668 nt, synthetic construct
  misc_feature 1..1668: note = derived and/or modified CDS sequence (wt) from RVFV(ZH-548)__DQ380206.1__IgE-leader_Gn(delSP)-variant1
  source 1..1668: mol_type = other RNA
atggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatag

SEQ ID NO: 17223 - RNA, 1662 nt, synthetic construct
  misc_feature 1..1662: note = derived and/or modified CDS sequence (wt) from RVFV(ZH-548)__DQ380206.1__IgE-leader_Gn(delSP)-variant2
  source 1..1662: mol_type = other RNA
atggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatag

SEQ ID NO: 17224 - RNA, 1662 nt, synthetic construct
  misc_feature 1..1662: note = derived and/or modified CDS sequence (wt) from RVFV(ZH-548)__DQ380206.1__IgE-leader_Gn(delSP)-variant2
  source 1..1662: mol_type = other RNA
atggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatag

SEQ ID NO: 17225 - RNA, 1578 nt, synthetic construct
  misc_feature 1..1578: note = derived and/or modified CDS sequence (wt) from RVFV(ZH-548)__DQ380206.1__IgE-leader_Gc
  source 1..1578: mol_type = other RNA
atggactggacctggatcctgttcctcgtggccgccgcgacccgcgtccacagctgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17226 - RNA, 1578 nt, synthetic construct
  misc_feature 1..1578: note = derived and/or modified CDS sequence (wt) from RVFV(ZH-548)__DQ380206.1__IgE-leader_Gc
  source 1..1578: mol_type = other RNA
atggactggacctggatcctgttcctcgtggccgccgcgacccgcgtccacagctgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatag

SEQ ID NO: 17227 - RNA, 738 nt, synthetic construct; identical to SEQ ID NO: 5523
  misc_feature 1..738: note = derived and/or modified CDS sequence (opt4) from RVFV(ZH-548)__DQ380151.1__N
  source 1..738: mol_type = other RNA

SEQ ID NO: 17228 - RNA, 3594 nt, synthetic construct
  misc_feature 1..3594: note = derived and/or modified CDS sequence (opt4) from RVFV(ZH-548)__DQ380206.1__GP
  source 1..3594: mol_type = other RNA
atgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgtcacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 17229 - RNA, 3204 nt, synthetic construct
  misc_feature 1..3204: note = derived and/or modified CDS sequence (opt4) from RVFV(ZH-548)__DQ380206.1__Gn-Gc
  source 1..3204: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 17230 - RNA, 2955 nt, synthetic construct
  misc_feature 1..2955: note = derived and/or modified CDS sequence (opt4) from RVFV(ZH-548)__DQ380206.1__Gne_SP-Gn_Gc
  source 1..2955: mol_type = other RNA
atggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccatggccggcatcgccatgaccgtgctgcccgccctggccgtgttcgccctggcccccgtggtgttcgccgaggactgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 17231 - RNA, 3189 nt, synthetic construct
  misc_feature 1..3189: note = derived and/or modified CDS sequence (opt4) from RVFV(ZH-548)__DQ380206.1__IgE-leader_Gn(delSP)-Gc-variant1
  source 1..3189: mol_type = other RNA
atggactggacctggatcctgttcctggtggccgccgccaccagagtgcacagcgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 17232 - RNA, 3183 nt, synthetic construct
  misc_feature 1..3183: note = derived and/or modified CDS sequence (opt4) from RVFV(ZH-548)__DQ380206.1__IgE-leader_Gn(delSP)-Gc-variant2
  source 1..3183: mol_type = other RNA
atggactggacctggatcctgttcctggtggccgccgccaccagagtgcacagcccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 17233 - RNA, 1668 nt, synthetic construct
  misc_feature 1..1668: note = derived and/or modified CDS sequence (opt4) from RVFV(ZH-548)__DQ380206.1__IgE-leader_Gn(delSP)-variant1
  source 1..1668: mol_type = other RNA
atggactggacctggatcctgttcctggtggccgccgccaccagagtgcacagcgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctga

SEQ ID NO: 17234 - RNA, 1662 nt, synthetic construct
  misc_feature 1..1662: note = derived and/or modified CDS sequence (opt4) from RVFV(ZH-548)__DQ380206.1__IgE-leader_Gn(delSP)-variant2
  source 1..1662: mol_type = other RNA
atggactggacctggatcctgttcctggtggccgccgccaccagagtgcacagcccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctga

SEQ ID NO: 17235 - RNA, 1578 nt, synthetic construct
  misc_feature 1..1578: note = derived and/or modified CDS sequence (opt4) from RVFV(ZH-548)__DQ380206.1__IgE-leader_Gc
  source 1..1578: mol_type = other RNA
atggactggacctggatcctgttcctggtggccgccgccaccagagtgcacagctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctga

SEQ ID NO: 17236 - RNA, 738 nt, synthetic construct; identical to SEQ ID NO: 6215
  misc_feature 1..738: note = derived and/or modified CDS sequence (opt3) from RVFV(ZH-548)__DQ380151.1__N
  source 1..738: mol_type = other RNA

SEQ ID NO: 17237 - RNA, 3594 nt, synthetic construct; identical to SEQ ID NO: 11090
  misc_feature 1..3594: note = derived and/or modified CDS sequence (opt3) from RVFV(ZH-548)__DQ380206.1__GP
  source 1..3594: mol_type = other RNA

SEQ ID NO: 17238 - RNA, 3204 nt, synthetic construct; identical to SEQ ID NO: 11240
  misc_feature 1..3204: note = derived and/or modified CDS sequence (opt3) from RVFV(ZH-548)__DQ380206.1__Gn-Gc
  source 1..3204: mol_type = other RNA

SEQ ID NO: 17239 - RNA, 2955 nt, synthetic construct
  misc_feature 1..2955: note = derived and/or modified CDS sequence (opt3) from RVFV(ZH-548)__DQ380206.1__Gne_SP-Gn_Gc
  source 1..2955: mol_type = other RNA
atggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctatggccggcattgcaatgaccgtgctccctgcccttgctgttttcgccctggcacccgtggtattcgcggaagactgcagtgagttgatccaagctagcagccgcatcactacatgttctaccgaaggagtcaacacgaagtgcagactatcaggcaccgccctgattagggcagggagtgtgggagccgaggcttgtctcatgctgaaaggtgttaaggaagatcagacaaaatttcttaagataaagactgtgagctccgagctgtcttgccgggagggccagtcgtactggaccgggagcttctccccaaaatgtttgtcaagtcgccgatgccacctcgtcggagaatgtcatgtgaatagatgcctgtcttggagggacaacgagacaagcgccgaattttccttcgtaggcgagtcaactaccatgcgggaaaataagtgttttgagcagtgcggtgggtggggctgcggatgtttcaacgtgaaccccagctgcttatttgttcacacatatctgcaatctgtccgtaaagaggcactacgcgtgttcaattgtatcgactgggtgcataagctcaccctggaaattactgattttgacggctccgtcagtacgatcgatcttggggcttcctcttccagattcacaaactggggatcagttagtttgagcctggacgccgagggtatatcgggctccaattcttttagcttcattgaatcacctgggaaaggatacgcgatcgtggatgagccatttagtgagatcccgaggcagggcttcctcggtgaaattcggtgcaactccgagtctagcgtgctgtccgcccacgaatcatgtcttcgagctcccaatctgatcagctacaagcctatgattgaccagttggagtgcaccactaacctcatagatccattcgtagtctttgaacgcgggagtctgccccagaccagaaatgacaaaacattcgcagcctctaagggcaacaggggagtgcaggctttttccaagggcagcgttcaagccgatttaaccctgatgttcgacaattttgaggtggatttcgtcggggcagcggtgtcgtgtgacgccgcttttctaaacctcactggatgctattcatgtaatgccggcgcacgggtttgcctgtctatcacaagtacgggtaccgggtcccttagcgctcacaacaaagatggatctttgcatattgtgctgcctagcgagaatggcactaaggaccagtgtcagatcctccacttcacagtaccagaagtcgaggaagagtttatgtactcctgcgacggtgatgaacgccccctgttagtgaaaggcaccctgatcgccattgacccgttcgatgacagaagggaggcagggggagagtcaacagtggtcaaccctaagagtggcagctggaactttttcgattggttttctgggcttatgtcctggttcggaggcccattgaaaactatactcctgatctgcctatatgttgccctgtcaattggtctcttctttctgcttatctacttggggcgtaccggactgagtaagatgtggttagctgcgacgaagaaagccagctga

SEQ ID NO: 17240 - RNA, 3189 nt, synthetic construct
  misc_feature 1..3189: note = derived and/or modified CDS sequence (opt3) from RVFV(ZH-548)__DQ380206.1__IgE-leader_Gn(delSP)-Gc-variant1
  source 1..3189: mol_type = other RNA
atggactggacatggatcctgttcctcgtggccgctgcaacaagagtccacagcgaggatccccatcttaggaaccggcctggcaaggggcacaattacattgacggaatgactcaggaagatgccacgtgcaaaccagttacctatgcgggtgcttgttcctcttttgacgtgctgttggagaagggcaaattcccgttatttcaatcatacgcccatcaccgcacactgctagaagcagtacatgatactataatcgccaaggctgatccccctagttgcgacctcctgagcgcacacgggaacccatgtatgaaagagaaacttgtgatgaagacccactgccccaatgactatcagtccgcccattacctgaacaatgatggaaaaatggcttctgtcaagtgtcctccaaaatatgaattgacagaggactgcaacttctgtcgacagatgaccggcgcctcgctcaagaaaggttcataccccctgcaggatctgttttgccaaagcagtgaggacgatgggtccaagctcaagactaaaatgaagggagtgtgtgaagttggcgtgcaggcgttaaagaagtgcgacggccagctgtctacagcacacgaggtcgtgcctttcgccgtatttaaaaatagcaagaaagtttatcttgacaagttggatctgaagaccgaagagaacctactcccagactccttcgtgtgttttgagcataaagggcagtacaagggaacgatggattcaggtcaaactaaacgtgaactgaagagtttcgacattagccagtgcccgaaaatcggcgggcacggatctaagaagtgcaccggcgatgctgccttttgttccgcatacgagtgcacagctcagtatgccaatgcgtactgttcacacgccaacggtagcgggattgtccagatccaagtgagtggagtgtggaaaaagcccctttgcgtcggctatgaaagagttgtggtaaaaagggagctgtctgcaaagcctatacagcgggtggaaccatgtactacctgcatcacaaaatgtgagccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagacatcggcgtgcacatggcccatgatgaccagagcgtatcaagtaaaatagttgcacactgtcccccgcaggatccttgcctggtgcatgactgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgataatataaaccaagttaatcgagaaattgggtggatggagggcggacagctcgtgctgggcaaccctgctcccatcccaagacatgcccccatccctaggtactcaacataccttatgctgttgctcattgtcagttatgcaagcgcgtgctccgaactgatccaggcttcttcgcggattaccacgtgtagcaccgagggggtgaacacaaagtgccgtttatccggaactgccctgatacgcgcaggttcagtaggcgccgaggcttgtctaatgctcaaaggggtgaaggaagaccagaccaaattcctgaagatcaaaacagttagttctgagcttagctgcagagaaggacaatcctactggactggctcatttagcccaaagtgtttgtcttccaggcggtgccacctggtcggtgagtgtcatgtgaatcgatgcctcagttggcgcgacaacgaaaccagcgccgagttctcttttgtgggggaatccacaaccatgagagagaataaatgcttcgagcagtgtggcggatggggctgcgggtgttttaacgtcaatccgtcatgcctgttcgttcacacttatcttcagagtgtgaggaaggaagcactgcgggtgtttaactgtattgattgggtacacaagttgacgctcgagatcacagacttcgatggaagcgtctcgaccatcgacctgggtgcttcctctagccgctttactaattggggctcagtgagtttatccctggatgccgaagggatttctggaagcaactccttctcatttatagagagccccggcaaaggttacgcgatcgttgacgagcctttcagtgaaattccaagacaggggttcctaggcgagatcaggtgcaattctgaatccagcgtgctctcggcccatgagtcatgtctgcgtgctcccaaccttatttcttataagcctatgatcgatcaattggaatgcaccacaaatctgatagacccatttgtcgtgttcgagcggggaagtctcccccagacccgaaacgataaaacttttgcagcctccaagggcaatagaggggttcaggctttcagcaaaggatctgtgcaggccgacctgacattaatgtttgataacttcgaggtagactttgtcggcgcagcggtgagctgtgatgccgctttcctgaatcttacgggttgctactcctgtaacgccggggcaagggtgtgcttgtcaatcaccagtactggaacaggcagcctctctgctcacaacaaggacggttccctgcatattgtcctaccgtcagaaaatggcaccaaggaccaatgccagatcctgcactttacagttcctgaggtggaagaggagttcatgtatagttgtgatggggacgaacgcccactcctggtaaaaggaactcttattgccatcgatccctttgacgatcggagagaggcaggcggggaaagcaccgtggtcaaccctaagtccggatcttggaatttctttgactggttctcgggcttgatgagctggttcggtgggcccctgaaaacgatattactcatttgcctgtacgtggccctttcaatcggactgtttttcttgctcatttacctgggcaggaccggtctatccaagatgtggctggctgcgaccaaaaaggccagttga

SEQ ID NO: 17241 - RNA, 3183 nt, synthetic construct
  misc_feature 1..3183: note = derived and/or modified CDS sequence (opt3) from RVFV(ZH-548)__DQ380206.1__IgE-leader_Gn(delSP)-Gc-variant2
  source 1..3183: mol_type = other RNA
atggactggacatggatcctgttcctcgtggccgctgcaacaagagtccacagcccccatcttaggaaccggcctggcaaggggcacaattacattgatggaatgactcaggaggacgccacgtgcaaaccagttacctatgcgggtgcttgttcctcttttgatgtgctgttggaaaagggcaaattcccgttatttcaatcatacgcccatcaccgcacactgctagaggcagtacatgacactataatcgccaaggctgatccccctagttgcgacctcctgagcgcacacgggaacccatgtatgaaagaaaaacttgtgatgaagacccactgccccaatgattatcagtccgcccattacctgaacaatgacggaaaaatggcttctgtcaagtgtcctccaaaatatgagttgacagaagattgcaacttctgtcgacagatgaccggcgcctcgctcaagaaaggttcataccccctgcaggacctgttttgccaaagcagtgaggatgacgggtccaagctcaagactaaaatgaagggagtgtgtgaggttggcgtgcaggcgttaaagaagtgcgatggccagctgtctacagcacacgaagtcgtgcctttcgccgtatttaaaaatagcaagaaagtttatcttgacaagttggacctgaagaccgaggaaaacctactcccagattccttcgtgtgttttgagcataaagggcagtacaagggaacgatggactcaggtcaaactaaacgtgagctgaagagtttcgatattagccagtgcccgaaaatcggcgggcacggatctaagaagtgcaccggcgacgctgccttttgttccgcatacgaatgcacagctcagtatgccaatgcgtactgttcacacgccaacggtagcgggattgtccagatccaagtgagtggagtgtggaaaaagcccctttgcgtcggctatgagagagttgtggtaaaaagggaactgtctgcaaagcctatacagcgggtggagccatgtactacctgcatcacaaaatgtgaaccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagatatcggcgtgcacatggcccatgacgatcagagcgtatcaagtaaaatagttgcacactgtcccccgcaggacccttgcctggtgcatgattgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgacaatataaaccaagttaatcgagagattgggtggatggaaggcggacagctcgtgctgggcaaccctgctcccatcccaagacatgcccccatccctaggtactcaacataccttatgctgttgctcattgtcagttatgcaagcgcgtgctccgagctgatccaggcttcttcgcggattaccacgtgtagcaccgaaggggtgaacacaaagtgccgtttatccggaactgccctgatacgcgcaggttcagtaggcgccgaggcttgtctaatgctcaaaggggtgaaggaagatcagaccaaattcctgaagatcaaaacagttagttctgagcttagctgcagagagggacaatcctactggactggctcatttagcccaaagtgtttgtcttccaggcggtgccacctggtcggtgaatgtcatgtgaatcgatgcctcagttggcgcgacaacgagaccagcgccgagttctcttttgtgggggaatccacaaccatgagagaaaataaatgcttcgagcagtgtggcggatggggctgcgggtgttttaacgtcaatccgtcatgcctgttcgttcacacttatcttcagagtgtgaggaaggaggcactgcgggtgtttaactgtattgactgggtacacaagttgacgctcgaaatcacagatttcgacggaagcgtctcgaccatcgatctgggtgcttcctctagccgctttactaattggggctcagtgagtttatccctggacgccgaggggatttctggaagcaactccttctcatttatagaaagccccggcaaaggttacgcgatcgttgatgagcctttcagtgagattccaagacaggggttcctaggcgaaatcaggtgcaattctgagtccagcgtgctctcggcccatgaatcatgtctgcgtgctcccaaccttatttcttataagcctatgatcgaccaattggagtgcaccacaaatctgatagatccatttgtcgtgttcgaacggggaagtctcccccagacccgaaacgacaaaacttttgcagcctccaagggcaatagaggggttcaggctttcagcaaaggatctgtgcaggccgatctgacattaatgtttgacaacttcgaggtagattttgtcggcgcagcggtgagctgtgacgccgctttcctgaatcttacgggttgctactcctgtaacgccggggcaagggtgtgcttgtcaatcaccagtactggaacaggcagcctctctgctcacaacaaggatggttccctgcatattgtcctaccgtcagagaatggcaccaaggaccaatgccagatcctgcactttacagttcctgaagtggaggaagagttcatgtatagttgtgacggggatgaacgcccactcctggtaaaaggaactcttattgccatcgacccctttgatgaccggagagaggcaggcggggagagcaccgtggtcaaccctaagtccggatcttggaatttctttgattggttctcgggcttgatgagctggttcggtgggcccctgaaaacgatattactcatttgcctgtacgtggccctttcaatcggactgtttttcttgctcatttacctgggcaggaccggtctatccaagatgtggctggctgcgaccaaaaaggccagttga

SEQ ID NO: 17242 - RNA, 1668 nt, synthetic construct
  misc_feature 1..1668: note = derived and/or modified CDS sequence (opt3) from RVFV(ZH-548)__DQ380206.1__IgE-leader_Gn(delSP)-variant1
  source 1..1668: mol_type = other RNA
atggactggacctggatcctgttcctcgtggccgctgcaacaagagtccacagcgaggatccccatcttaggaaccggcctggcaaggggcacaattacattgacggaatgactcaggaagatgccacgtgcaaaccagttacctatgcgggtgcttgttcctcttttgacgtgctgttggagaagggcaaattcccgttatttcaatcatacgcccatcaccgcacactgctagaagcagtacatgatactataatcgccaaggctgatccccctagttgcgacctcctgagcgcacacgggaacccatgtatgaaagagaaacttgtgatgaagacccactgccccaatgactatcagtccgcccattacctgaacaatgatggaaaaatggcttctgtcaagtgtcctccaaaatatgaattgacagaggactgcaacttctgtcgacagatgaccggcgcctcgctcaagaaaggttcataccccctgcaggatctgttttgccaaagcagtgaggacgatgggtccaagctcaagactaaaatgaagggagtgtgtgaagttggcgtgcaggcgttaaagaagtgcgacggccagctgtctacagcacacgaggtcgtgcctttcgccgtatttaaaaatagcaagaaagtttatcttgacaagttggatctgaagaccgaagagaacctactcccagactccttcgtgtgttttgagcataaagggcagtacaagggaacgatggattcaggtcaaactaaacgtgaactgaagagtttcgacattagccagtgcccgaaaatcggcgggcacggatctaagaagtgcaccggcgatgctgccttttgttccgcatacgagtgcacagctcagtatgccaatgcgtactgttcacacgccaacggtagcgggattgtccagatccaagtgagtggagtgtggaaaaagcccctttgcgtcggctatgaaagagttgtggtaaaaagggagctgtctgcaaagcctatacagcgggtggaaccatgtactacctgcatcacaaaatgtgagccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagacatcggcgtgcacatggcccatgatgaccagagcgtatcaagtaaaatagttgcacactgtcccccgcaggatccttgcctggtgcatgactgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgataatataaaccaagttaatcgagaaattgggtggatggagggcggacagctcgtgctgggcaaccctgctcccatcccaagacatgcccccatccctaggtactcaacataccttatgctgttgctcattgtcagttatgcaagcgcgtga

SEQ ID NO: 17243 - RNA, 1662 nt, synthetic construct
  misc_feature 1..1662: note = derived and/or modified CDS sequence (opt3) from RVFV(ZH-548)__DQ380206.1__IgE-leader_Gn(delSP)-variant2
  source 1..1662: mol_type = other RNA
atggactggacctggatcctgttcctcgtggccgctgcaacaagagtccacagcccccatcttaggaaccggcctggcaaggggcacaattacattgatggaatgactcaggaggacgccacgtgcaaaccagttacctatgcgggtgcttgttcctcttttgatgtgctgttggaaaagggcaaattcccgttatttcaatcatacgcccatcaccgcacactgctagaggcagtacatgacactataatcgccaaggctgatccccctagttgcgacctcctgagcgcacacgggaacccatgtatgaaagaaaaacttgtgatgaagacccactgccccaatgattatcagtccgcccattacctgaacaatgacggaaaaatggcttctgtcaagtgtcctccaaaatatgagttgacagaagattgcaacttctgtcgacagatgaccggcgcctcgctcaagaaaggttcataccccctgcaggacctgttttgccaaagcagtgaggatgacgggtccaagctcaagactaaaatgaagggagtgtgtgaggttggcgtgcaggcgttaaagaagtgcgatggccagctgtctacagcacacgaagtcgtgcctttcgccgtatttaaaaatagcaagaaagtttatcttgacaagttggacctgaagaccgaggaaaacctactcccagattccttcgtgtgttttgagcataaagggcagtacaagggaacgatggactcaggtcaaactaaacgtgagctgaagagtttcgatattagccagtgcccgaaaatcggcgggcacggatctaagaagtgcaccggcgacgctgccttttgttccgcatacgaatgcacagctcagtatgccaatgcgtactgttcacacgccaacggtagcgggattgtccagatccaagtgagtggagtgtggaaaaagcccctttgcgtcggctatgagagagttgtggtaaaaagggaactgtctgcaaagcctatacagcgggtggagccatgtactacctgcatcacaaaatgtgaaccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagatatcggcgtgcacatggcccatgacgatcagagcgtatcaagtaaaatagttgcacactgtcccccgcaggacccttgcctggtgcatgattgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgacaatataaaccaagttaatcgagagattgggtggatggaaggcggacagctcgtgctgggcaaccctgctcccatcccaagacatgcccccatccctaggtactcaacataccttatgctgttgctcattgtcagttatgcaagcgcgtga

SEQ ID NO: 17244 - RNA, 1578 nt, synthetic construct
  misc_feature 1..1578: note = derived and/or modified CDS sequence (opt3) from RVFV(ZH-548)__DQ380206.1__IgE-leader_Gc
  source 1..1578: mol_type = other RNA
atggactggacctggatcctgttcctcgtggccgctgcaacaagagtccacagctgctccgagcttattcaggcctcttcaaggataactacgtgtagtaccgaaggcgttaatacaaagtgccggctgagcgggactgcgttgatccgcgctggatccgtgggtgccgaggcatgtttaatgctgaaaggcgtaaaggaagatcaaaccaaatttctaaagattaaaacagtgtcttcggagctctcatgccgagaagggcagagctactggaccggaagtttctcccccaagtgtctgtctagccgtagatgccatcttgtcggcgagtgtcacgtgaataggtgcctgtcctggcgggacaacgagacttcagccgaatttagtttcgttggtgagagcacaaccatgcgcgaaaataagtgttttgagcagtgcgggggatggggctgtggctgcttcaacgtgaatccttcttgcttgtttgtccatacgtatctccagtccgtgagaaaagaggctctgagggtattcaactgtatcgattgggttcacaagctgactctcgaaattaccgactttgatgggtcagtgagcacaatcgacttaggagcaagttcttcccggttcactaattggggtagcgtctcgctgtctcttgatgccgagggcatatccgggtcaaacagttttagcttcatcgaatccccaggaaaaggctacgctattgtggacgagccgttttctgaaatcccccgccaaggtttcttgggggagattcgatgcaatagcgagtcaagtgtgctgtccgcccatgaaagctgtctaagagcgcctaacctcatctcttataagccaatgatagatcagctggagtgcaccacaaatcttattgaccccttcgtcgtttttgaaaggggatcactgcctcagacccggaacgataaaacgttcgcagccagtaagggcaatcgtggcgtgcaggcttttagcaaggggtccgtacaagccgacttgactctcatgttcgataactttgaggtggacttcgtcggagcagctgtgtcttgtgacgccgcgtttctgaatttaacaggttgctactcgtgtaacgccggcgcacgcgtttgcctgagcatcacctccactgggacaggatcactcagtgctcacaacaaagatggctctcttcacattgtgctgccaagcgaaaatggtaccaaggaccagtgtcagatcttgcatttcacggtccccgaggtggaggaagagtttatgtattcctgcgatggggacgaaagacctctactggtaaaaggcaccctcatcgccattgatccattcgacgataggcgggaggctggaggcgaatcaacagttgtgaacccgaaaagcgggtcttggaactttttcgactggttttccggactgatgagttggttcggtggcccccttaaaactatactgttgatctgtctctacgtcgccctgagcattgggttattctttctgctaatctatctcggacgaaccggcctgtctaagatgtggcttgcagccacaaagaaggcttcctga

SEQ ID NO: 17245 - RNA, 738 nt, synthetic construct; identical to SEQ ID NO: 6907
  misc_feature 1..738: note = derived and/or modified CDS sequence (opt1) from RVFV(ZH-548)__DQ380151.1__N
  source 1..738: mol_type = other RNA

SEQ ID NO: 17246 - RNA, 3594 nt, synthetic construct; identical to SEQ ID NO: 12733
  misc_feature 1..3594: note = derived and/or modified CDS sequence (opt1) from RVFV(ZH-548)__DQ380206.1__GP
  source 1..3594: mol_type = other RNA

SEQ ID NO: 17247 - RNA, 3204 nt, synthetic construct
  misc_feature 1..3204: note = derived and/or modified CDS sequence (opt1) from RVFV(ZH-548)__DQ380206.1__Gn-Gc
  source 1..3204: mol_type = other RNA
atggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctga

SEQ ID NO: 17248 - RNA, 2955 nt, synthetic construct
  misc_feature 1..2955: note = derived and/or modified CDS sequence (opt1) from RVFV(ZH-548)__DQ380206.1__Gne_SP-Gn_Gc
  source 1..2955: mol_type = other RNA
atggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccatggcggggatcgccatgaccgtgctgcccgccctggccgtgttcgcgctcgcccccgtcgtgttcgccgaggactgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctga

SEQ ID NO: 17249 - RNA, 3189 nt, synthetic construct
  misc_feature 1..3189: note = derived and/or modified CDS sequence (opt1) from RVFV(ZH-548)__DQ380206.1__IgE-leader_Gn(delSP)-Gc-variant1
  source 1..3189: mol_type = other RNA
atggactggacctggatcctgttcctcgtggccgccgcgacccgcgtccacagcgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctga

SEQ ID NO: 17250 - RNA, 3183 nt, synthetic construct
  misc_feature 1..3183: note = derived and/or modified CDS sequence (opt1) from RVFV(ZH-548)__DQ380206.1__IgE-leader_Gn(delSP)-Gc-variant2
  source 1..3183: mol_type = other RNA
atggactggacctggatcctgttcctcgtggccgccgcgacccgcgtccacagcccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctga

SEQ ID NO: 17251 - RNA, 1668 nt, synthetic construct
  misc_feature 1..1668: note = derived and/or modified CDS sequence (opt1) from RVFV(ZH-548)__DQ380206.1__IgE-leader_Gn(delSP)-variant1
  source 1..1668: mol_type = other RNA
atggactggacctggatcctgttcctcgtggccgccgcgacccgcgtccacagcgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctga

SEQ ID NO: 17252 - RNA, 1662 nt, synthetic construct
  misc_feature 1..1662: note = derived and/or modified CDS sequence (opt1) from RVFV(ZH-548)__DQ380206.1__IgE-leader_Gn(delSP)-variant2
  source 1..1662: mol_type = other RNA
atggactggacctggatcctgttcctcgtggccgccgcgacccgcgtccacagcccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctga

SEQ ID NO: 17253 - RNA, 1578 nt, synthetic construct
  misc_feature 1..1578: note = derived and/or modified CDS sequence (opt1) from RVFV(ZH-548)__DQ380206.1__IgE-leader_Gc
  source 1..1578: mol_type = other RNA
atggactggacctggatcctgttcctcgtggccgccgcgacccgcgtccacagctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctga

SEQ ID NO: 17254 - RNA, 738 nt, synthetic construct; identical to SEQ ID NO: 6907
  misc_feature 1..738: note = derived and/or modified CDS sequence (opt1) from RVFV(ZH-548)__DQ380151.1__N
  source 1..738: mol_type = other RNA

SEQ ID NO: 17255 - RNA, 3594 nt, synthetic construct; identical to SEQ ID NO: 12733
  misc_feature 1..3594: note = derived and/or modified CDS sequence (opt1) from RVFV(ZH-548)__DQ380206.1__GP
  source 1..3594: mol_type = other RNA

SEQ ID NO: 17256 - RNA, 3204 nt, synthetic construct; identical to SEQ ID NO: 12883
  misc_feature 1..3204: note = derived and/or modified CDS sequence (opt1) from RVFV(ZH-548)__DQ380206.1__Gn-Gc
  source 1..3204: mol_type = other RNA

SEQ ID NO: 17257 - RNA, 2955 nt, synthetic construct
  misc_feature 1..2955: note = derived and/or modified CDS sequence (opt1) from RVFV(ZH-548)__DQ380206.1__Gne_SP-Gn_Gc
  source 1..2955: mol_type = other RNA
atggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgatggccgggatcgccatgaccgtgctgcccgccctggccgtcttcgcgctcgcccccgtggtgttcgccgaggactgcagcgagctgatccaggcctccagccggatcaccacgtgctccaccgagggcgtcaacaccaagtgccgcctgagcgggaccgccctcatccgggcgggcagcgtgggggccgaggcctgcctgatgctgaagggcgtgaaggaggaccagacgaagttcctcaagatcaagaccgtctccagcgagctgtcctgccgcgagggccagagctactggaccgggtccttcagccccaagtgcctgtccagccggcgctgccacctcgtgggcgagtgccacgtgaaccggtgcctgtcctggcgcgacaacgagaccagcgccgagttctccttcgtcggggagagcacgaccatgcgggagaacaagtgcttcgagcagtgcggcggctgggggtgcggctgcttcaacgtgaacccctcctgcctgttcgtgcacacctacctccagagcgtccgcaaggaggccctgcgggtgttcaactgcatcgactgggtgcacaagctgaccctcgagatcacggacttcgacgggtccgtcagcaccatcgacctgggcgcgtccagcagccgcttcaccaactgggggtccgtgagcctgtccctggacgccgagggcatcagcggctccaacagcttctccttcatcgagagcccggggaagggctacgccatcgtggacgagcccttctccgagatcccccggcaggggttcctcggcgagatccgctgcaacagcgagtccagcgtcctgtccgcccacgagagctgcctgcgcgcgccgaacctcatctcctacaagcccatgatcgaccagctggagtgcaccaccaacctgatcgaccccttcgtggtgttcgagcgggggagcctcccccagacgcgcaacgacaagaccttcgccgcctccaagggcaaccggggcgtccaggccttcagcaaggggtccgtgcaggccgacctgaccctgatgttcgacaacttcgaggtggacttcgtcggcgcggccgtgagctgcgacgccgccttcctcaacctgaccgggtgctacagctgcaacgccggcgcgcgcgtgtgcctgtccatcacgagcaccgggaccggctccctcagcgcccacaacaaggacggctccctgcacatcgtcctgccgagcgagaacgggaccaaggaccagtgccagatcctccacttcacggtgcccgaggtggaggaggagttcatgtactcctgcgacggcgacgagcggcccctgctggtcaaggggaccctcatcgccatcgaccccttcgacgaccgccgggaggccggcggggagagcaccgtggtgaacccgaagtccggcagctggaacttcttcgactggttctccggcctgatgagctggttcgggggccccctgaagaccatcctcctgatctgcctgtacgtcgccctctccatcgggctgttcttcctgctcatctacctgggccgcacgggcctgagcaagatgtggctcgcggccaccaagaaggcctcctga

SEQ ID NO: 17258 - RNA, 3189 nt, synthetic construct
  misc_feature 1..3189: note = derived and/or modified CDS sequence (opt1) from RVFV(ZH-548)__DQ380206.1__IgE-leader_Gn(delSP)-Gc-variant1
  source 1..3189: mol_type = other RNA
atggactggacctggatcctgttcctcgtggccgccgcgacccgcgtccacagcgaggacccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgcagcgagctgatccaggcctccagccggatcacgacctgctccaccgagggcgtgaacaccaagtgccgcctgagcgggaccgccctcatccgggcgggctccgtcggcgccgaggcctgcctgatgctgaagggggtgaaggaggaccagaccaagttcctcaagatcaagaccgtgagctccgagctgagctgccgcgagggccagtcctactggacggggagcttctcccccaagtgcctgagctcccggcgctgccacctggtcggcgagtgccacgtgaaccgctgcctcagctggcgggacaacgagacctccgccgagttcagcttcgtgggcgagagcaccaccatgcgcgagaacaagtgcttcgagcagtgcgggggctgggggtgcggctgcttcaacgtcaacccctcctgcctgttcgtgcacacgtacctgcagagcgtgcggaaggaggccctccgcgtcttcaactgcatcgactgggtgcacaagctgaccctggagatcaccgacttcgacgggtccgtgagcaccatcgacctcggcgcgtccagctcccggttcaccaactggggcagcgtctccctgagcctggacgccgaggggatctccggcagcaactccttcagcttcatcgagtccccggggaagggctacgccatcgtggacgagcccttcagcgagatcccccgccaggggttcctcggcgagatccggtgcaactccgagagctccgtgctgagcgcccacgagagctgcctgcgcgcgcccaacctcatctcctacaagccgatgatcgaccagctggagtgcacgaccaacctgatcgaccccttcgtcgtgttcgagcggggcagcctcccccagacccgcaacgacaagaccttcgccgcctccaaggggaaccggggcgtgcaggccttcagcaaggggtccgtccaggccgacctgacgctgatgttcgacaacttcgaggtggacttcgtgggcgcggccgtcagctgcgacgccgccttcctcaacctgaccgggtgctactcctgcaacgccggcgcgcgcgtgtgcctgagcatcacctccaccggcacggggagcctctccgcccacaacaaggacggcagcctgcacatcgtgctgccctccgagaacgggaccaaggaccagtgccagatcctccacttcaccgtcccggaggtggaggaggagttcatgtacagctgcgacggcgacgagcggcccctgctggtgaaggggaccctcatcgccatcgaccccttcgacgaccgccgggaggccggcggcgagtccacggtcgtgaaccccaagagcgggtcctggaacttcttcgactggttcagcggcctgatgtcctggttcgggggcccgctgaagaccatcctcctgatctgcctgtacgtggccctcagcatcggcctgttcttcctgctcatctacctggggcgcaccggcctgagcaagatgtggctcgcggccaccaagaaggcctcctga

SEQ ID NO: 17259 - RNA, 3183 nt, synthetic construct
  misc_feature 1..3183: note = derived and/or modified CDS sequence (opt1) from RVFV(ZH-548)__DQ380206.1__IgE-leader_Gn(delSP)-Gc-variant2
  source 1..3183: mol_type = other RNA
atggactggacctggatcctgttcctcgtggccgccgcgacccgcgtccacagcccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgcagcgagctgatccaggcctccagccggatcacgacctgctccaccgagggcgtgaacaccaagtgccgcctgagcgggaccgccctcatccgggcgggctccgtcggcgccgaggcctgcctgatgctgaagggggtgaaggaggaccagaccaagttcctcaagatcaagaccgtgagctccgagctgagctgccgcgagggccagtcctactggacggggagcttctcccccaagtgcctgagctcccggcgctgccacctggtcggcgagtgccacgtgaaccgctgcctcagctggcgggacaacgagacctccgccgagttcagcttcgtgggcgagagcaccaccatgcgcgagaacaagtgcttcgagcagtgcgggggctgggggtgcggctgcttcaacgtcaacccctcctgcctgttcgtgcacacgtacctgcagagcgtgcggaaggaggccctccgcgtcttcaactgcatcgactgggtgcacaagctgaccctggagatcaccgacttcgacgggtccgtgagcaccatcgacctcggcgcgtccagctcccggttcaccaactggggcagcgtctccctgagcctggacgccgaggggatctccggcagcaactccttcagcttcatcgagtccccggggaagggctacgccatcgtggacgagcccttcagcgagatcccccgccaggggttcctcggcgagatccggtgcaactccgagagctccgtgctgagcgcccacgagagctgcctgcgcgcgcccaacctcatctcctacaagccgatgatcgaccagctggagtgcacgaccaacctgatcgaccccttcgtcgtgttcgagcggggcagcctcccccagacccgcaacgacaagaccttcgccgcctccaaggggaaccggggcgtgcaggccttcagcaaggggtccgtccaggccgacctgacgctgatgttcgacaacttcgaggtggacttcgtgggcgcggccgtcagctgcgacgccgccttcctcaacctgaccgggtgctactcctgcaacgccggcgcgcgcgtgtgcctgagcatcacctccaccggcacggggagcctctccgcccacaacaaggacggcagcctgcacatcgtgctgccctccgagaacgggaccaaggaccagtgccagatcctccacttcaccgtcccggaggtggaggaggagttcatgtacagctgcgacggcgacgagcggcccctgctggtgaaggggaccctcatcgccatcgaccccttcgacgaccgccgggaggccggcggcgagtccacggtcgtgaaccccaagagcgggtcctggaacttcttcgactggttcagcggcctgatgtcctggttcgggggcccgctgaagaccatcctcctgatctgcctgtacgtggccctcagcatcggcctgttcttcctgctcatctacctggggcgcaccggcctgagcaagatgtggctcgcggccaccaagaaggcctcctga

SEQ ID NO: 17260 - RNA, 1668 nt, synthetic construct
  misc_feature 1..1668: note = derived and/or modified CDS sequence (opt1) from RVFV(ZH-548)__DQ380206.1__IgE-leader_Gn(delSP)-variant1
  source 1..1668: mol_type = other RNA
atggactggacctggatcctgttcctcgtggccgccgcgacccgcgtccacagcgaggacccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctga

SEQ ID NO: 17261 - RNA, 1662 nt, synthetic construct
  misc_feature 1..1662: note = derived and/or modified CDS sequence (opt1) from RVFV(ZH-548)__DQ380206.1__IgE-leader_Gn(delSP)-variant2
  source 1..1662: mol_type = other RNA
atggactggacctggatcctgttcctcgtggccgccgcgacccgcgtccacagcccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctga

SEQ ID NO: 17262 - RNA, 1578 nt, synthetic construct
  misc_feature 1..1578: note = derived and/or modified CDS sequence (opt1) from RVFV(ZH-548)__DQ380206.1__IgE-leader_Gc
  source 1..1578: mol_type = other RNA
atggactggacctggatcctgttcctcgtggccgccgcgacccgcgtccacagctgctccgagctgatccaggccagctcccggatcacgacctgcagcaccgagggcgtgaacaccaagtgccgcctgtccgggacggccctcatccgggccggcagcgtgggggccgaggcgtgcctgatgctgaagggcgtcaaggaggaccagaccaagttcctcaagatcaagaccgtgtccagcgagctgtcctgccgcgaggggcagagctactggaccggctccttcagccccaagtgcctgtccagccggcgctgccacctcgtgggcgagtgccacgtcaaccggtgcctgtcctggcgcgacaacgagacgagcgccgagttctccttcgtgggggagagcaccaccatgcgggagaacaagtgcttcgagcagtgcggcgggtggggctgcgggtgcttcaacgtgaacccgtcctgcctgttcgtccacacctacctccagagcgtgcgcaaggaggccctgcgggtgttcaactgcatcgactgggtccacaagctgacgctcgagatcaccgacttcgacggcagcgtgtccaccatcgacctgggcgccagctccagccgcttcaccaactgggggtccgtgagcctgtccctcgacgcggagggcatcagcgggtccaacagcttctccttcatcgagagccccggcaagggctacgccatcgtcgacgagcccttctccgagatcccccggcaggggttcctgggcgagatccgctgcaacagcgagtccagcgtgctgtccgcccacgagagctgcctccgggccccgaacctgatctcctacaagcccatgatcgaccagctggagtgcacgaccaacctcatcgaccccttcgtggtcttcgagcgcgggagcctgccccagacccggaacgacaagaccttcgccgcgagcaagggcaaccgcggggtgcaggccttctccaagggcagcgtgcaggccgacctgacgctcatgttcgacaacttcgaggtcgacttcgtgggcgccgccgtgtcctgcgacgcggccttcctgaacctgaccgggtgctacagctgcaacgccggcgcccgggtctgcctctccatcaccagcaccgggacgggctccctgagcgcccacaacaaggacgggtccctgcacatcgtgctcccgagcgagaacggcaccaaggaccagtgccagatcctgcacttcaccgtccccgaggtggaggaggagttcatgtactcctgcgacggcgacgagcgccccctgctcgtgaaggggaccctgatcgcgatcgaccccttcgacgaccggcgcgaggccggcggggagagcacggtcgtgaacccgaagtccggcagctggaacttcttcgactggttctccgggctgatgagctggttcggcggccccctcaagaccatcctgctgatctgcctctacgtggccctgtccatcgggctgttcttcctcctgatctacctgggccgcaccgggctcagcaagatgtggctggccgccaccaagaaggcgagctga

SEQ ID NO: 17263 - RNA, 738 nt, synthetic construct; identical to SEQ ID NO: 7599
  misc_feature 1..738: note = derived and/or modified CDS sequence (opt5) from RVFV(ZH-548)__DQ380151.1__N
  source 1..738: mol_type = other RNA

SEQ ID NO: 17264 - RNA, 3594 nt, synthetic construct; identical to SEQ ID NO: 14376
  misc_feature 1..3594: note = derived and/or modified CDS sequence (opt5) from RVFV(ZH-548)__DQ380206.1__GP
  source 1..3594: mol_type = other RNA

SEQ ID NO: 17265 - RNA, 3204 nt, synthetic construct; identical to SEQ ID NO: 14526
  misc_feature 1..3204: note = derived and/or modified CDS sequence (opt5) from RVFV(ZH-548)__DQ380206.1__Gn-Gc
  source 1..3204: mol_type = other RNA

SEQ ID NO: 17266 - RNA, 2955 nt, synthetic construct
  misc_feature 1..2955: note = derived and/or modified CDS sequence (opt5) from RVFV(ZH-548)__DQ380206.1__Gne_SP-Gn_Gc
  source 1..2955: mol_type = other RNA
atggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccatggctgggattgccatgaccgtgctgcccgctctggccgttttcgcgctcgcccctgtggtcttcgctgaagactgctccgagctgatccaagccagctctagaattacaacctgttccacagaaggagtgaacaccaagtgccggcttagcggcacggctctgatccgcgccgggtccgtgggcgcggaggcctgtctcatgctgaaaggagttaaggaagatcagacaaaatttcttaagattaagaccgtctctagcgagctgtcctgcagagagggccagtcttactggaccgggagcttctcccccaaatgtctcagctctcggcgctgccacctggtgggagaatgtcatgtgaatagatgcctgtcctggcgggacaacgagacaagcgctgaattttctttcgtcggcgagtccaccacaatgcgcgaaaataagtgttttgagcagtgcgggggatggggctgcgggtgtttcaacgtgaacccgagctgcctctttgttcacacgtatctgcaatctgtgagaaaagaggcccttcgggtcttcaattgtatcgactgggtgcataagctgaccctcgaaatcacagattttgacggcagcgtttccaccattgatctgggagcttctagctccagattcacaaactggggcagcgtgtccctgtctcttgacgccgaggggatcagcggatccaattcttttagcttcattgaatcccctggcaaagggtacgccatcgtcgatgagcccttttctgagattcctcgccagggattcctcggcgaaatccggtgcaacagcgagtccagcgtgctgtctgctcacgaatcctgtctgagagcgcccaatctcatcagctacaagcctatgattgaccagctggagtgcaccacgaaccttatcgatcccttcgttgtgtttgaacgcgggtctctgccgcagacccggaatgacaaaacattcgccgcttccaagggcaacagaggagtccaagcctttagcaagggctctgtgcaggccgatctcaccctgatgttcgacaattttgaggtggatttcgtcggggctgccgtttcctgtgacgcggcttttctgaaccttacaggatgctatagctgtaatgccggcgcccgcgtgtgcctctccattaccagcacggggacaggatctctgagcgctcacaacaaagatggctccctgcatatcgtgctcccttctgagaatgggaccaaggaccagtgtcagattctgcacttcacagtccccgaagtggaggaagagtttatgtacagctgcgacggcgatgaacggccccttctggttaaaggaaccctcatcgccattgaccctttcgatgacagacgcgaggcgggcggggagtccaccgtggtcaacccgaagtctggaagctggaactttttcgattggttttccggcctgatgtcttggttcgggggacccctgaaaacaatccttctcatctgcctgtatgtggctctgagcattggcctcttctttctgcttatctacctgggccggacggggctctccaagatgtggctggccgccaccaagaaagctagctga

SEQ ID NO: 17267 - RNA, 3189 nt, synthetic construct
  misc_feature 1..3189: note = derived and/or modified CDS sequence (opt5) from RVFV(ZH-548)__DQ380206.1__IgE-leader_Gn(delSP)-Gc-variant1
  source 1..3189: mol_type = other RNA
atggactggacctggatcctgttcctcgtggccgctgccacaagagtccacagcgaggatccccatctgcggaaccgccctggcaaggggcacaattacattgacggaatgacgcaggaagatgcgacctgcaaaccggttacatatgctggcgcctgttcctcttttgacgtgcttctggagaaggggaaattccccctctttcaaagctacgcccatcacagaaccctgcttgaagctgtgcatgatacaatcattgccaaggctgaccctccctcctgcgatctgctctctgcccacggaaacccttgtatgaaagagaagctggtcatgaagacccactgccccaatgactatcagagcgcgcattacctgaacaatgatggcaaaatggcctccgtgaagtgtcctccgaaatatgaactcacagaggactgcaacttctgtcggcagatgaccggggcttctctgaagaaaggaagctacccccttcaggatctgttttgccaatccagcgaggacgatggctctaagctcaagacgaaaatgaagggcgtttgtgaagtgggggtccaggccctgaaaaagtgcgacggacagctttccaccgctcacgaggtggttcctttcgccgtgtttaaaaatagcaagaaagtctatctggacaagctcgatctgaagacagaagagaacctgctccccgactctttcgtgtgttttgagcataaaggccagtacaaggggaccatggattccggacaaacaaaacgcgaacttaagagcttcgacatctctcagtgccctaaaattggcgggcacggatccaagaagtgcaccggcgatgcggccttttgtagcgcttacgagtgcacggcccagtatgctaatgcctactgttcccacgccaacggctctgggatcgtgcagatccaagtcagcggagtttggaaaaagcccctgtgcgtgggctatgaaagagtggtcgtgaaacgggagctgtccgctaagccgattcagcgcgttgaaccttgtacaacctgcatcacaaaatgtgagccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgacatcggggtccacatggcccatgatgaccagagcgtgtcttccaaaattgtcgcccactgtccccctcaggatccgtgccttgtgcatgactgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgataatatcaaccaagttaatcgcgaaattggctggatggaagggggacagctcgtcctgggcaaccccgcccctatccccagacatgcgccgattcctcggtacagcacctaccttatgctgctcctgatcgtgtcctatgcctctgcttgcagcgaactgatccaggcctcctctcgcattacaacctgtagcacggagggggtgaacacaaagtgcagactctccggcaccgctctgatccgggccggaagcgtcggcgcggaagcctgtcttatgctgaaaggggtgaaggaggaccagaccaaattcctcaagattaaaacagtttcttccgagctgagctgcagagaaggacaatcttactggaccggctcctttagccccaagtgtctgtctagccgccggtgccaccttgtgggggagtgtcatgtcaatagatgcctctcctggcgcgacaacgaaacaagcgctgagttctcttttgtgggagaatccacgaccatgcgggagaataaatgcttcgagcagtgtggcgggtggggctgcggatgttttaacgttaatcctagctgcctgttcgtgcacacatatctgcagtccgtcagaaaggaagccctccgcgtgtttaactgtatcgattgggttcacaagctgacccttgagattacagacttcgatggctctgtgagcaccatcgacctgggggcttcctctagccggtttacgaattggggatccgtctctctcagcctggatgccgaaggcatttccgggagcaactctttctcctttatcgagagccccggaaaaggctacgccatcgtggacgagcctttctctgaaattcccagacaggggttcctgggcgagatccgctgcaattccgaaagctctgtgctttccgctcatgagagctgtctccgggcgccgaacctgatttcctataagcctatgatcgatcaactggaatgcaccacaaatctcattgacccctttgtcgttttcgagagaggaagcctgccccagacccgcaacgataaaacatttgccgcttctaagggcaatagaggggtgcaggccttcagcaaaggatccgtgcaggccgaccttaccctgatgtttgataacttcgaggtcgactttgtgggcgctgccgtttcttgtgatgcggctttcctcaatctgacggggtgctacagctgtaacgccggagcccgggtgtgcctgtccatcacatctaccggcacagggagcctttccgctcacaacaaggacggctctctccatatcgtcctgcctagcgaaaatggaaccaaggaccaatgccagattctgcactttaccgtgccggaggttgaagaggagttcatgtattcctgtgatggcgacgagcggcccctcctggtgaaagggacacttatcgccattgatccttttgacgatcgcagagaggcgggaggcgaaagcacggtcgtgaaccccaagtctgggtcctggaatttctttgactggttcagcggactgatgtcttggttcggcggccctctcaaaaccatcctgctgatttgcctttacgttgctctctccatcgggctgtttttcctgctcatctacctgggacggacaggccttagcaagatgtggctggccgccaccaaaaaggcttcctga

SEQ ID NO: 17268 - RNA, 3183 nt, synthetic construct
  misc_feature 1..3183: note = derived and/or modified CDS sequence (opt5) from RVFV(ZH-548)__DQ380206.1__IgE-leader_Gn(delSP)-Gc-variant2
  source 1..3183: mol_type = other RNA
atggactggacctggatcctgttcctcgtggccgctgccacaagagtccacagcccccatctgcggaaccgccctggcaaggggcacaattacattgatggaatgacgcaggaggacgcgacctgcaaaccggttacatatgctggcgcctgttcctcttttgatgtgcttctggaaaaggggaaattccccctctttcaaagctacgcccatcacagaaccctgcttgaggctgtgcatgacacaatcattgccaaggctgatcctccctcctgcgacctgctctctgcccacggaaacccttgtatgaaagaaaagctggtcatgaagacccactgccccaatgattatcagagcgcgcattacctgaacaatgacggcaaaatggcctccgtgaagtgtcctccgaaatatgagctcacagaagattgcaacttctgtcggcagatgaccggggcttctctgaagaaaggaagctacccccttcaggacctgttttgccaatccagcgaggatgacggctctaagctcaagacgaaaatgaagggcgtttgtgaggtgggggtccaggccctgaaaaagtgcgatggacagctttccaccgctcacgaagtggttcctttcgccgtgtttaaaaatagcaagaaagtctatctggacaagctcgacctgaagacagaggaaaacctgctccccgattctttcgtgtgttttgagcataaaggccagtacaaggggaccatggactccggacaaacaaaacgcgagcttaagagcttcgatatctctcagtgccctaaaattggcgggcacggatccaagaagtgcaccggcgacgcggccttttgtagcgcttacgaatgcacggcccagtatgctaatgcctactgttcccacgccaacggctctgggatcgtgcagatccaagtcagcggagtttggaaaaagcccctgtgcgtgggctatgagagagtggtcgtgaaacgggaactgtccgctaagccgattcagcgcgttgagccttgtacaacctgcatcacaaaatgtgaaccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgatatcggggtccacatggcccatgacgatcagagcgtgtcttccaaaattgtcgcccactgtccccctcaggacccgtgccttgtgcatgattgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgacaatatcaaccaagttaatcgcgagattggctggatggaagggggacagctcgtcctgggcaaccccgcccctatccccagacatgcgccgattcctcggtacagcacctaccttatgctgctcctgatcgtgtcctatgcctctgcttgcagcgagctgatccaggcctcctctcgcattacaacctgtagcacggaaggggtgaacacaaagtgcagactctccggcaccgctctgatccgggccggaagcgtcggcgcggaggcctgtcttatgctgaaaggggtgaaggaagatcagaccaaattcctcaagattaaaacagtttcttccgagctgagctgcagagagggacaatcttactggaccggctcctttagccccaagtgtctgtctagccgccggtgccaccttgtgggggaatgtcatgtcaatagatgcctctcctggcgcgacaacgagacaagcgctgagttctcttttgtgggagaatccacgaccatgcgggaaaataaatgcttcgagcagtgtggcgggtggggctgcggatgttttaacgttaatcctagctgcctgttcgtgcacacatatctgcagtccgtcagaaaggaggccctccgcgtgtttaactgtatcgactgggttcacaagctgacccttgaaattacagatttcgacggctctgtgagcaccatcgatctgggggcttcctctagccggtttacgaattggggatccgtctctctcagcctggacgccgagggcatttccgggagcaactctttctcctttatcgaaagccccggaaaaggctacgccatcgtggatgagcctttctctgagattcccagacaggggttcctgggcgaaatccgctgcaattccgagagctctgtgctttccgctcatgaaagctgtctccgggcgccgaacctgatttcctataagcctatgatcgaccaactggagtgcaccacaaatctcattgatccctttgtcgttttcgaaagaggaagcctgccccagacccgcaacgacaaaacatttgccgcttctaagggcaatagaggggtgcaggccttcagcaaaggatccgtgcaggccgatcttaccctgatgtttgacaacttcgaggtcgattttgtgggcgctgccgtttcttgtgacgcggctttcctcaatctgacggggtgctacagctgtaacgccggagcccgggtgtgcctgtccatcacatctaccggcacagggagcctttccgctcacaacaaggatggctctctccatatcgtcctgcctagcgagaatggaaccaaggaccaatgccagattctgcactttaccgtgccggaagttgaggaagagttcatgtattcctgtgacggcgatgaacggcccctcctggtgaaagggacacttatcgccattgacccttttgatgaccgcagagaggcgggaggcgagagcacggtcgtgaaccccaagtctgggtcctggaatttctttgattggttcagcggactgatgtcttggttcggcggccctctcaaaaccatcctgctgatttgcctttacgttgctctctccatcgggctgtttttcctgctcatctacctgggacggacaggccttagcaagatgtggctggccgccaccaaaaaggcttcctga

SEQ ID NO: 17269 - RNA, 1668 nt, synthetic construct
  misc_feature 1..1668: note = derived and/or modified CDS sequence (opt5) from RVFV(ZH-548)__DQ380206.1__IgE-leader_Gn(delSP)-variant1
  source 1..1668: mol_type = other RNA
atggactggacctggatcctgttcctcgtggccgctgccacaagagtccacagcgaggatccccatctgcggaaccgccctggcaaggggcacaattacattgacggaatgacgcaggaggatgcgacctgcaaaccggttacatatgctggcgcctgttcctcttttgacgtgcttctggagaaggggaaattccccctctttcaaagctacgcccatcacagaaccctgcttgaagctgtgcatgatacaatcattgccaaggctgaccctccctcctgcgatctgctctctgcccacggaaacccttgtatgaaagagaagctggtcatgaagacccactgccccaatgactatcagagcgcgcattacctgaacaatgatggcaaaatggcctccgtgaagtgtcctccgaaatatgaactcacagaggactgcaacttctgtcggcagatgaccggggcttctctgaagaaaggaagctacccccttcaggatctgttttgccaatccagcgaggacgatggctctaagctcaagacgaaaatgaagggcgtttgtgaagtgggggtccaggccctgaaaaagtgcgacggacagctttccaccgctcacgaggtggttcctttcgccgtgtttaaaaatagcaagaaagtctatctggacaagctcgatctgaagacagaagagaacctgctccccgactctttcgtgtgttttgagcataaaggccagtacaaggggaccatggattccggacaaacaaaacgcgaacttaagagcttcgacatctctcagtgccctaaaattggcgggcacggatccaagaagtgcaccggcgatgcggccttttgtagcgcttacgagtgcacggcccagtatgctaatgcctactgttcccacgccaacggctctgggatcgtgcagatccaagtcagcggagtttggaaaaagcccctgtgcgtgggctatgaaagagtggtcgtgaaacgggagctgtccgctaagccgattcagcgcgttgaaccttgtacaacctgcatcacaaaatgtgagccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgacatcggggtccacatggcccatgatgaccagagcgtgtcttccaaaattgtcgcccactgtccccctcaggatccgtgccttgtgcatgactgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgataatatcaaccaagttaatcgcgaaattggctggatggaagggggacagctcgtcctgggcaaccccgcccctatccccagacatgcgccgattcctcggtacagcacctaccttatgctgctcctgatcgtgtcctatgcctctgcttga

SEQ ID NO: 17270 - RNA, 1662 nt, synthetic construct
  misc_feature 1..1662: note = derived and/or modified CDS sequence (opt5) from RVFV(ZH-548)__DQ380206.1__IgE-leader_Gn(delSP)-variant2
  source 1..1662: mol_type = other RNA
atggactggacctggatcctgttcctcgtggccgctgccacaagagtccacagcccccatctgcggaaccgccctggcaaggggcacaattacattgatggaatgacgcaggaggacgcgacctgcaaaccggttacatatgctggcgcctgttcctcttttgatgtgcttctggaaaaggggaaattccccctctttcaaagctacgcccatcacagaaccctgcttgaggctgtgcatgacacaatcattgccaaggctgatcctccctcctgcgacctgctctctgcccacggaaacccttgtatgaaagaaaagctggtcatgaagacccactgccccaatgattatcagagcgcgcattacctgaacaatgacggcaaaatggcctccgtgaagtgtcctccgaaatatgagctcacagaagattgcaacttctgtcggcagatgaccggggcttctctgaagaaaggaagctacccccttcaggacctgttttgccaatccagcgaggatgacggctctaagctcaagacgaaaatgaagggcgtttgtgaggtgggggtccaggccctgaaaaagtgcgatggacagctttccaccgctcacgaagtggttcctttcgccgtgtttaaaaatagcaagaaagtctatctggacaagctcgacctgaagacagaggaaaacctgctccccgattctttcgtgtgttttgagcataaaggccagtacaaggggaccatggactccggacaaacaaaacgcgagcttaagagcttcgatatctctcagtgccctaaaattggcgggcacggatccaagaagtgcaccggcgacgcggccttttgtagcgcttacgaatgcacggcccagtatgctaatgcctactgttcccacgccaacggctctgggatcgtgcagatccaagtcagcggagtttggaaaaagcccctgtgcgtgggctatgagagagtggtcgtgaaacgggaactgtccgctaagccgattcagcgcgttgagccttgtacaacctgcatcacaaaatgtgaaccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgatatcggggtccacatggcccatgacgatcagagcgtgtcttccaaaattgtcgcccactgtccccctcaggacccgtgccttgtgcatgattgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgacaatatcaaccaagttaatcgcgagattggctggatggaagggggacagctcgtcctgggcaaccccgcccctatccccagacatgcgccgattcctcggtacagcacctaccttatgctgctcctgatcgtgtcctatgcctctgcttga

SEQ ID NO: 17271 - RNA, 1578 nt, synthetic construct
  misc_feature 1..1578: note = derived and/or modified CDS sequence (opt5) from RVFV(ZH-548)__DQ380206.1__IgE-leader_Gc
  source 1..1578: mol_type = other RNA
atggactggacatggatcctgttcctcgtggccgctgccacaagagtccacagctgctccgagctgattcaggcgtctagccggatcacgacctgttccacagaaggcgttaataccaagtgccgcctttctgggacagctctgattagagccggaagcgtgggcgccgaggcttgtctcatgctgaaaggggtgaaggaagatcaaaccaaatttcttaagatcaaaacagtctcctctgagctgagctgccgggaaggacagtcctactggaccggcagcttctctcccaagtgtctctccagccgcagatgccatctggtgggggagtgtcacgttaatcggtgcctgtcttggcgcgacaacgagacgtccgccgaatttagcttcgtgggagagtctaccacaatgagagaaaataagtgttttgagcagtgcggcggctgggggtgtggatgcttcaacgtcaatccttcctgcctctttgtgcatacctatctgcagagcgttcggaaagaggctctccgcgtgttcaactgtattgattgggtccacaagctgacactcgaaatcaccgactttgatggctccgtgtctacgatcgacctgggggccagctccagcagattcacaaattggggatctgtgtcccttagcctggatgcggagggcatttctgggagcaactccttttctttcatcgaaagcccgggaaaaggctacgccattgtcgacgagcccttttccgaaatccctcggcaaggcttcctcggggagattcgctgcaatagcgagtcttccgttctgagcgctcatgaatcttgtctgagagcccccaacctcatctcctataagcctatgattgatcagctggagtgcaccacaaatcttatcgaccccttcgtggtgtttgaacggggaagcctgcctcagacccgcaacgataaaaccttcgctgcctccaagggcaatagaggggtccaggcgttttctaagggaagcgtgcaagccgacctcacactgatgttcgataactttgaggttgacttcgtgggcgctgccgtctcctgtgacgctgcctttcttaatctgacggggtgctactcttgtaacgccggagctcgggtgtgcctcagcatcacctccacaggcaccggcagcctgtctgcgcacaacaaagatgggtccctgcacattgttctcccgagcgaaaatggaacaaaggaccagtgtcagatcctgcatttcaccgtgcccgaggtcgaggaagagtttatgtattcttgcgatggcgacgaaagacctcttctggtgaaagggacgctcattgccatcgatcccttcgacgatcgccgggaggctggaggcgaatccacagtcgtgaaccctaagagcgggtcttggaactttttcgactggtttagcggcctgatgtcctggttcggaggcccccttaaaaccattctgctcatctgtctgtacgttgccctgagcatcgggcttttctttctgcttatttatctgggaagaaccggcctctctaagatgtggctggccgctaccaaaaaggcctcctga

SEQ ID NO: 17272 - RNA, 738 nt, synthetic construct
  misc_feature 1..738: note = derived and/or modified CDS sequence (opt11) from RVFV(ZH-548)__DQ380151.1__N
  source 1..738: mol_type = other RNA
atggacaactaccaagaactcgcaatccagttcgccgcccaagccgtcgaccgcaacgaaatcgaacaatgggtccgagaatttgcctaccaaggcttcgacgcccgacgagtcatcgaactcctcaaacaatacggaggcgccgactgggaaaaagacgccaagaaaatgatcgtactagccctcacccgaggcaacaaaccccgccgaatgatgatgaaaatgtcaaaagaaggcaaagccaccgtcgaagccctcatcaacaaatacaaactcaaggaaggcaacccctcccgggacgaactcacactctcccgcgtagccgcagccctcgccggctggacctgccaagccctcgtcgtcctatccgaatggcttccagtcacaggcacaaccatggacggcctctcccccgcctatccccgccacatgatgcacccctcattcgccggcatggtcgacccctcactccccggcgactacctacgagccatcctagacgcacactccctctacctcctccaattctcccgcgtcatcaaccccaacctacgcggccgcaccaaagaagaagtagccgccaccttcacacaaccaatgaacgccgcagtcaactccaacttcatctcccacgaaaaacgccgcgaatttctcaaagccttcggccttgtagactccaacggcaaaccctccgccgccgtcatggctgccgcacaagcgtacaaaaccgccgcataa

SEQ ID NO: 17273 - RNA, 3594 nt, synthetic construct
  misc_feature 1..3594: note = derived and/or modified CDS sequence (opt11) from RVFV(ZH-548)__DQ380206.1__GP
  source 1..3594: mol_type = other RNA
atgtacgttctgctcaccatactcatctccgtcctcgtctgtgaagcagttattcgggtctcactatcgagcactcgggaagagacatgcttcggagactccaccaatccagaaatgatagagggtgcctgggactcattacgagaggaagaaatgccagaggaactctcgtgctcaatatcgggcattcgggaggtcaaaacgtccagtcaagagctatatcgcgcactgaaagcaatcattgcagccgacggactcaataacatcacgtgccatggaaaagacccagaggacaaaatatcactaatcaagggcccaccacacaagaaacgagtcggcatagtccgatgcgaacgtcgccgcgacgccaaacaaatcggtcgagaaaccatggccggaatcgcaatgaccgtactacccgccctcgcggttttcgccctagcacccgtcgtcttcgcggaagacccccacctccgcaaccggccaggcaaaggtcacaactatatagacggaatgacgcaggaagacgcaacatgtaaaccagtaacctatgccggcgcatgcagctcatttgacgtcctcctcgagaaaggcaagttcccgctattccaaagctacgctcaccaccgcaccctcctggaggccgtacacgacacaataatcgcgaaagcggacccacccagttgcgatctactatcggcccacggaaatccctgtatgaaagaaaagctagttatgaaaacccattgccccaacgactaccagagcgcccactacctcaacaatgatgggaaaatggcctcagtcaaatgcccgcccaaatacgaactaaccgaggactgcaacttctgccgccaaatgaccggagcctcactaaagaaaggctcttaccccctccaagacctcttttgccaatcgtccgaggacgatggctcaaaacttaaaacaaaaatgaaaggtgtctgcgaagtcggagtgcaagccctgaagaaatgtgacggacaactctccacagcccacgaagtagtacccttcgccgtattcaaaaactcaaagaaagtatacctggacaaactggaccttaaaacagaggaaaacctgctgcccgactcctttgtgtgcttcgaacacaaaggccaatacaaaggcactatggacagcggacagaccaaacgggaactaaagagcttcgacatctcccaatgtcccaaaattggcggccacggatccaagaaatgtacaggggacgccgccttctgctcagcctacgaatgcaccgcgcaatacgctaacgcgtactgctcccatgccaacgggtccggcatcgtccagatccaagtctccggcgtgtggaagaaacctctctgtgtaggctatgaacgcgtcgtagtcaaaagagaactctctgctaaacccatccaacgggtggaaccatgcaccacgtgcataacaaaatgcgagccacacggcctcgttgttcgatccacaggctttaaaatctcaagcgctgtagcctgcgcatccggcgtctgcgtcaccggttctcagtccccatcaacagagatcacactgaaataccccggcatatcccaatcatcgggcggcgacataggagttcacatggctcacgacgaccagagcgtatcctccaaaatcgtcgcccactgcccaccccaggacccctgcctcgttcatgactgcatcgtctgtgcacacggcctcataaactaccaatgccacaccgccctatccgcctttgtcgtggtattcgtattcagcagcatcgcaatcatatgccttgcaatcctgtaccgcgtcctgaaatgccttaaaattgccccacgcaaagtcctcaacccactgatgtggatcactgccttcatacgctggatatacaagaaaatggtcgcccgcgtagccgacaacatcaaccaagtaaaccgagagataggctggatggagggcggccaactcgtccttggcaacccagccccaatacccaggcacgcaccgattcctcggtattccacatacctcatgctccttctgatcgtcagctacgcatcggcctgctccgaactcatacaggcatccagcagaattacaacctgttcaaccgagggcgtcaacacgaaatgtcgtctgtccggtaccgcactaatacgcgctggttcagtaggagcggaggcctgtcttatgcttaaaggcgtaaaagaggatcaaaccaaattcctgaaaatcaaaacagtgagctcggaactctcatgccgcgaaggacaatcctactggacaggatcgttctcaccaaaatgcctatctagcagacgatgccacctcgtcggggagtgccatgtgaatcgctgcctctcctggcgagacaacgagacaagcgccgagttctctttcgtaggggaaagcaccaccatgagagaaaacaaatgcttcgaacagtgcggcggatggggatgcggctgctttaacgtcaacccctcgtgcctgtttgtacatacttacctccaatcagtacgcaaagaagcattgcgcgttttcaattgcatcgactgggtccacaaactcaccctagaaatcacagacttcgacggctccgtctcgaccatcgacctgggcgccagctcctcaaggttcacgaactggggctccgtatccctctcccttgacgcggaaggaatctccggcagcaactcgttctcattcatcgaatcacccggaaaaggctacgccatcgtcgacgaacccttctccgaaataccgagacaaggattcctcggagaaatcagatgcaactcagagagctccgtgctgtctgcccacgaaagttgcctcagagcacccaacctcatcagctacaaaccaatgatcgatcaactagaatgcactactaacctaatagacccctttgtcgttttcgaacgcggctccctcccacaaaccaggaacgacaaaacctttgcagctagtaaaggaaacagaggagtccaagcgttctcaaaaggctcagtccaagcagatctaaccctcatgttcgacaacttcgaggttgacttcgtgggcgccgcagtctcctgtgacgcagcgttcttgaacctcacaggctgctactcttgcaacgccggagcaagagtttgcctctcaatcacgagcacaggaacgggatccctatcagcccacaacaaagacggcagccttcacatcgtactcccgtctgagaacggaaccaaagatcaatgtcaaatcctacacttcaccgtacccgaagtcgaagaagagttcatgtactcttgcgacggcgacgaacgaccactactcgtcaaagggaccctcatcgcaattgacccattcgatgatcgccgcgaagctggaggcgagagcacagtcgtcaaccccaaaagcggctcctggaactttttcgactggttcagcggactcatgtcctggtttggtggcccactcaaaacaatcctcctcatctgcctctacgtagccctgagcatcggcctcttcttcctccttatctacctagggcgaacagggctttcgaaaatgtggcttgctgccaccaagaaagcctcctag

SEQ ID NO: 17274 - RNA, 3204 nt, synthetic construct
  misc_feature 1..3204: note = derived and/or modified CDS sequence (opt11) from RVFV(ZH-548)__DQ380206.1__Gn-Gc
  source 1..3204: mol_type = other RNA
atggcaggaatagcaatgacggttctgccagcgctagccgttttcgcactagcaccagtcgtcttcgcggaagacccccatctacgcaaccgacccggaaaaggacacaactacatcgacggaatgacacaagaagatgcaacatgcaaaccagtcacatacgcaggcgcctgctcctccttcgacgtcctacttgagaaaggtaaattccccctctttcaaagctacgcgcaccaccgtaccctcctcgaagcagtccacgacacaatcatagcaaaggctgacccacccagctgtgacctcctctccgcccatggcaacccctgcatgaaggaaaaactcgtaatgaaaacacactgcccgaacgactaccaatccgcccactacctcaacaacgacggaaagatggcctctgttaagtgcccaccaaaatacgagctgaccgaagactgcaacttttgccgtcaaatgaccggagcctccctcaagaaagggtcatacccactccaagatctattttgccaaagctccgaggacgacggcagcaaattaaaaaccaagatgaaaggtgtatgcgaagtgggcgtccaggccctcaagaaatgcgacggccaactttccactgcacacgaagtggtacccttcgccgtgttcaaaaactccaagaaagtctatttagacaaactcgacctaaaaacggaagagaacctcctacccgactcatttgtctgctttgagcacaaaggccaatacaaaggaacaatggatagcgggcaaacaaaaagggaactcaagtccttcgacatcagccagtgccccaaaatcggcggacatgggagcaaaaagtgcaccggcgacgctgcattctgcagtgcctacgagtgcaccgcgcaatacgctaacgcatactgcagtcatgctaacggcagcggaattgtacaaatccaggtctccggcgtgtggaagaaaccactatgcgtaggctacgaacgggttgtcgtcaaaagagagctttccgccaaacccattcaacgagttgaaccatgcactacatgtatcaccaaatgtgaacctcatggtctagttgtccgctcgaccggattcaagatctcgagcgccgtagcctgcgcctccggagtgtgcgtcacaggctcacaatccccctcgacagaaattaccctgaaataccctggaatctcccagtcctcgggaggcgacataggggtacacatggcccacgacgaccaaagcgtctcctccaaaatagtagctcactgcccaccacaggacccctgtctcgtacacgactgcatagtatgtgcacatggtctcatcaactaccaatgccacacagcactcagtgcatttgtagttgtattcgtattctcctctatcgccatcatctgcctagccatactctacagggtcctcaaatgcctaaaaatcgcaccacgaaaagtcctcaaccccctaatgtggataaccgccttcatccgctggatatacaagaaaatggtcgcccgcgtcgcagacaacatcaatcaagtcaaccgtgaaatcggctggatggaaggaggacaactggtccttggaaacccagcgccaataccccgccacgccccaattcctcgatactccacctacctaatgcttctcctaatcgtatcctacgcctccgcctgcagcgaactcatacaggcttcctcacgcataactacgtgctccaccgaaggagttaacaccaaatgccgactctcagggacagccctaatcagagcgggaagtgtaggcgcagaagcctgccttatgctgaaaggagtcaaagaggaccaaacaaaattcctaaagatcaaaaccgtctcatctgagctcagctgccgcgaaggacaatcctactggacaggttccttctcccccaaatgcctgtcatcccgcagatgccatttagtcggcgagtgccatgtaaaccgatgcctctcctggcgcgacaacgagacttcagcggagttcagcttcgtaggggaatctacaaccatgcgtgagaacaagtgcttcgaacaatgcggaggctggggatgcggttgcttcaacgtcaacccatcctgcctattcgtacatacttacctccagtccgtcagaaaagaggcgctacgcgtcttcaactgtatagactgggttcacaaacttaccctggaaataaccgacttcgacggatccgtcagcacaatagatctgggagcttccagctcacgtttcacgaactgggggtccgtctcgctttctctagacgccgaaggcataagcggctccaactccttctccttcatcgaaagccccggcaaaggctacgccatcgtagacgagccattctcagagatcccccgccaaggcttcctcggcgagatcagatgtaacagcgaatcctccgtactctcagcacacgaatcctgccttcgcgcaccaaatcttatctcctacaaacccatgatcgaccaactagaatgtaccaccaatctaatagatcccttcgtagtattcgaacgcggctctctaccccaaacacgcaacgacaaaacattcgcggcctccaaagggaaccggggcgtgcaagccttctccaaaggaagtgtccaagccgatctcacactcatgttcgacaactttgaagtagacttcgtcggggcggccgtaagttgcgatgcggccttcctaaacctgaccggctgttactcatgcaacgcgggcgccagagtctgcctctccataacctccaccggaaccggatcactgtcagcacacaacaaagacggatccctacacatcgtccttccatccgaaaatggcacaaaagaccaatgccaaatcttacacttcaccgtcccagaagtagaagaagagttcatgtacagttgcgacggagatgagcgcccgttactcgtaaagggcacacttatagccattgacccgttcgacgacagacgtgaggccggaggagaaagcaccgtcgtaaatccaaagtcagggtcatggaacttcttcgactggttttccggattaatgtcctggttcggaggccctctcaaaactatactcctaatatgcctatacgtcgccctctccatcggcctattcttcctcctaatatacctcggacgcacaggcctctccaaaatgtggctagccgccaccaaaaaggcctcctaa

SEQ ID NO: 17275 - RNA, 2955 nt, synthetic construct
  misc_feature 1..2955: note = derived and/or modified CDS sequence (opt11) from RVFV(ZH-548)__DQ380206.1__Gne_SP-Gn_Gc
  source 1..2955: mol_type = other RNA
atggcaggaatcgccatgacagtcctaccagcacttgccgtatttgccctcgccccagtagtatttgccgaagacccacacctcagaaaccgacccggaaaaggacacaactatatcgatggcatgacccaggaagatgcaacatgcaaacctgtaacctacgccggcgcatgctccagcttcgacgtactacttgagaaaggcaaatttccactctttcaatcttacgctcaccaccgcacccttctagaggccgtccacgacacgatcatagctaaagccgacccaccaagctgcgacctcctctcagcccatggcaacccatgcatgaaagagaaactcgtaatgaaaacccactgccccaacgactaccagtccgctcactacctcaataacgacggaaaaatggcctcagtcaaatgcccacccaaatacgagcttacagaggactgcaacttctgccgccaaatgaccggagcctcactcaagaaaggaagctacccccttcaggacctattctgccagagctcagaagacgacggtagcaagctaaaaaccaaaatgaaaggggtttgcgaggtcggcgtccaggcgctcaagaaatgcgacggtcaactctctacagcacatgaagtcgtacccttcgccgttttcaaaaacagcaagaaagtctacctcgacaaactagacctcaaaaccgaagaaaacctactccccgacagcttcgtgtgcttcgaacacaaaggccaatataaaggcacgatggactccggacagaccaaaagggaactaaaatccttcgacatatcccaatgccccaaaatcggaggccacggatccaagaaatgcaccggagacgccgccttctgctcagcatacgaatgcacagcacaatacgccaacgcatactgcagccacgcaaacggatccggaatagtgcagatccaagtaagcggagtctggaagaaacccctctgtgtcggctacgaacgcgtggtcgtaaaaagagagctttcagctaaaccaatacaacgagtagaaccctgcaccacgtgcattacaaaatgcgaaccacacggcctcgtcgttcgcagcactggtttcaaaatatctagcgcggtagcatgcgcctcaggcgtatgcgtgaccggatcccagtcaccatcaacagaaatcaccctcaaatacccgggcatttcacaatcatcaggtggcgacatcggggtacacatggcacacgacgatcaatccgtctcttcaaaaatcgtcgcccactgcccaccccaggacccctgtttagtgcacgactgtatagtctgcgcccacggcctaattaactaccaatgccacaccgccatggccggaatcgcaatgacagtcttaccggccctcgcagtattcgccctagccccagttgtcttcgcagaagactgctcagaactaatccaagcctcttcccgaatcaccacatgcagcaccgaaggcgtcaacacaaaatgccgcctctcgggcaccgccctcatacgcgcaggcagcgtcggcgccgaagcgtgcctaatgcttaaaggagtcaaagaagatcaaaccaaatttctaaaaatcaaaactgtgagctcagaactctcatgcagagaaggacaaagctactggaccggatcattttctcctaaatgcctgagctctcgcagatgccacctcgtaggagagtgccatgtcaaccgctgtctctcttggcgagacaacgagacctccgcagagttcagcttcgtaggtgaatcaacaaccatgcgagaaaacaaatgcttcgaacaatgcggtggctggggttgcggatgcttcaacgtcaacccctcatgtctcttcgtccacacatacctccaaagcgttcgcaaagaagctctacgcgtattcaattgcattgattgggtacataagctcacactagaaatcacggactttgacggctcagtctcaaccatcgatctcggtgcatccagttcgcgcttcactaactggggaagcgtctcgctttccctcgatgccgaaggcatatccggatcgaactcattctcgttcattgaatcacccggcaaaggctacgccatcgtagatgaacccttcagtgaaatcccgagacaaggattcctaggagaaatccggtgcaactccgaatcgagcgtcctctccgcacacgaatcctgcctccgcgcccctaatctcatctcctacaaaccaatgatcgatcaactcgaatgtacaacaaacctgatcgatcccttcgtcgtgtttgaacgtggctcactcccccaaacccgcaatgacaaaacgttcgccgcttctaaaggcaaccggggcgtccaggctttcagcaagggctccgtccaagccgacctcacgctcatgttcgacaacttcgaagtcgacttcgtcggagccgctgtttcctgtgacgccgcatttctaaacttaaccgggtgctacagctgcaatgccggcgcaagagtatgcctctccatcacctcaaccggaactggctccctaagcgcccacaacaaagacggctcactccacatcgtcctaccaagcgaaaacggcacgaaagaccaatgccaaatcctgcactttaccgtacccgaagtcgaagaggagttcatgtatagctgcgacggcgacgaacgaccacttctagtcaaaggcacactcatcgccatcgaccccttcgacgaccgcagagaagcaggcggtgaatcaactgtggtaaaccccaaatcaggcagctggaacttcttcgactggttctccggactcatgagctggttcggcggcccccttaagaccatcttactcatctgcctatacgtcgcactatccatcggactcttctttctactcatctacctcggccgcacaggcctctctaaaatgtggctagccgcaaccaagaaagcaagttaa

SEQ ID NO: 17276 - RNA, 3189 nt, synthetic construct
  misc_feature 1..3189: note = derived and/or modified CDS sequence (opt11) from RVFV(ZH-548)__DQ380206.1__IgE-leader_Gn(delSP)-Gc-variant1
  source 1..3189: mol_type = other RNA
atggactggacctggatactgttcctcgtagccgccgctacccgcgtccatagtgaagacccacacctaagaaaccgccccggaaaagggcacaactacatagatggtatgacacaagaggacgcgacgtgtaaacccgtaacctatgctggagcttgtagctcctttgatgtccttctcgagaaaggaaaattccccctcttccaatcctacgcccaccacagaaccctactcgaggcagtgcatgacacaataatcgctaaagcagacccaccatcttgcgatctattatctgctcacggaaacccctgcatgaaagaaaagctagtcatgaaaacccactgccccaacgattaccaatcagcacattaccttaataacgacggcaaaatggcctccgtcaaatgtcccccaaaatacgaactcacagaggattgcaacttctgccgccagatgaccggcgcctccctcaagaaagggtcctaccctctccaagacctattctgccaatcctccgaagacgacggctccaaattaaaaacgaaaatgaaaggcgtctgcgaagtgggcgttcaagctctcaagaaatgcgacggtcaactatccaccgcacacgaagtcgttcccttcgcagtcttcaaaaattctaagaaagtctacctagacaaacttgacctaaaaaccgaagagaatctcctacccgactccttcgtctgcttcgaacacaaaggacaatacaaaggcaccatggattccggccaaacaaaacgcgaactcaaatccttcgacatctcacaatgtcccaaaataggaggtcacggatcgaagaaatgcaccggagacgctgccttctgctctgcatacgaatgcaccgcccaatatgccaacgcctactgttcacacgccaacggctccggcatagtccaaatacaagtctcgggcgtatggaagaaacccctctgcgtaggctacgagcgagtggtagtcaaaagagaactctccgccaaaccgatccaacgcgtcgagccatgcacaacgtgtattacaaaatgcgaaccacacgggctagttgtccggtcgaccgggttcaaaatctcttcagccgtagcctgcgcctcaggtgtatgcgtcaccggatcacaatccccgagcaccgaaataaccctaaaatacccggggatcagccagtcgtccggcggcgatatcggcgttcacatggcgcacgacgaccagagcgtcagcagcaaaatcgtcgcccactgtcctccccaagacccctgcctggtacacgactgcatcgtctgcgctcacggcctcataaactaccagtgccataccgccctgtccgccttcgttgtcgtattcgtcttctcctcaatcgccatcatctgcctagccatactataccgcgtactcaaatgtctaaaaatcgcaccccgcaaagtacttaaccctctaatgtggatcaccgcattcatccgctggatctataagaaaatggtagcccgggtcgccgacaacatcaaccaagtcaaccgtgaaatcggatggatggaaggcggacaactcgtcctgggcaaccccgccccaatcccgcgacacgccccaatccctcgctactccacctacctcatgctactactcatcgtaagctacgcttccgcatgctccgagctaatccaggcttcctcccgcatcacaacttgttcaacagagggcgtaaacacaaaatgtagactgtctggcacagccctaatacgtgcaggaagcgtaggagccgaagcctgcctcatgcttaaaggagtaaaagaagaccaaacgaaatttctcaaaatcaaaacagtcagttccgagctctcatgccgcgaaggccaatcctactggaccggcagtttctcccccaaatgcctaagcagtcgccgctgccacctcgtcggcgaatgccacgtaaatcgatgtttgtcatggcgagataatgaaacctccgcagagttttcatttgtaggcgaatccaccaccatgcgcgaaaacaaatgcttcgaacaatgcggaggttggggctgcggctgcttcaacgtgaacccgtcatgcctcttcgttcacacctatcttcaatccgtgcgcaaagaagcactccgcgtgtttaattgcatcgactgggtccacaaacttacccttgaaataactgacttcgacggctccgtctccacaatagacttaggagcctcatcatcaagattcaccaattggggatcagtttccctctcgctcgacgctgaaggtataagtggcagtaactcattctcattcatcgaatcacccggcaaaggctatgctatcgtagatgagcccttttccgagatcccacgacaaggatttctaggggaaattcgctgtaattcggagtcctccgtcctatcggcccacgaatcatgcctccgcgccccaaacctcatctcgtacaaacccatgatcgaccagttggaatgcaccacaaacctcattgaccccttcgtggtcttcgaacgaggaagcctcccccaaacacgcaacgacaaaaccttcgccgcctcgaagggcaaccgcggcgtacaagccttcagtaaaggatcggtccaagcagaccttaccctcatgttcgacaacttcgaggtcgacttcgttggagcggcggtgtcctgcgatgccgcattcctcaacctcacaggctgctactcctgcaacgctggagcacgcgtatgcttatcaataacctctactggaactggctcactatccgcccacaacaaggacggcagcctccacatcgtcctcccatcagaaaacggcacaaaagatcagtgccaaatactccactttacggtcccggaggtcgaagaagagttcatgtacagctgcgacggcgacgaacgccccctcctagtaaaaggtaccctgatagcaatcgaccccttcgatgaccgccgagaggccggcggggaatccacagtggtcaacccgaaatccggcagctggaacttcttcgactggttctccgggcttatgtcctggttcggcggccctctcaaaacgatactactaatctgcctatacgtcgcgctgtccataggcttattcttcctactaatataccttgggcgcactggcctctcaaagatgtggctggccgccaccaagaaggcctcctaa

SEQ ID NO: 17277 - RNA, 3183 nt, synthetic construct
  misc_feature 1..3183: note = derived and/or modified CDS sequence (opt11) from RVFV(ZH-548)__DQ380206.1__IgE-leader_Gn(delSP)-Gc-variant2
  source 1..3183: mol_type = other RNA
atggattggacgtggatcctgtttctcgtggccgccgcgaccagagtccacagcccacatctcagaaaccgcccgggcaagggacacaactacatagacggcatgacccaggaggacgcgacctgcaagcccgtgacctacgccggcgcctgtagcagcttcgacgtactgctggagaagggcaaattccccctgttccagtcctacgcacaccaccggacactgctcgaggcggtccatgacacaatcatagctaaggccgaccctccctcgtgcgaccttctatccgcgcacgggaatccctgcatgaaggagaagctcgtcatgaagacccactgtcccaacgactaccagagcgcccactacctgaacaacgacggcaaaatggcctctgtgaagtgccctcccaaatacgagctcacagaggattgcaacttctgcaggcagatgactggcgcctcgttaaagaaagggtcttaccctctgcaggacctgttctgccagagctccgaagacgacggaagcaagctcaagacgaagatgaagggcgtctgcgaggtgggcgtgcaggccctgaagaaatgcgacgggcagctgtccactgcccacgaggtcgtaccattcgcggtgttcaaaaacagcaagaaagtctacttggacaagctggatcttaagaccgaggagaacctactccccgactcttttgtgtgcttcgagcataaggggcagtataagggcacgatggacagtggacagacaaagcgagagctgaaaagtttcgacattagccagtgcccgaaaatcggcggtcacggctccaagaagtgcaccggcgacgccgccttctgctccgcctacgagtgtactgcccagtacgcgaacgcctactgcagccacgcaaatgggagtggcatagtgcagatccaggtcagcggggtatggaagaagccactatgcgtgggctacgagcgcgtggtggtgaagcgggaactgtccgctaagcccatccagcgcgtcgagccctgcaccacttgcatcaccaagtgcgagccccacgggctggtggtccggagcaccggtttcaaaatttccagcgccgtcgcgtgcgcgtccggtgtgtgcgtcaccgggagccagtcccccagcacggagatcaccctcaagtaccccggcatctcccagagctccgggggcgacatcggggtgcacatggcccacgacgaccaatctgtgtcctcaaagatcgtggcccactgccctccccaggacccctgcctggtgcacgactgcatcgtgtgcgcccacggcctgataaactaccagtgccacacggcgctcagcgcgtttgttgtagtgttcgtcttcagctccatcgccatcatctgcctagccattctgtaccgggtgctcaagtgcctgaagatcgctccccggaaagtgctgaatcctctgatgtggatcaccgccttcatccggtggatctacaagaagatggtggcccgggttgccgacaacatcaaccaagtgaaccgcgagatcggctggatggagggcgggcagctggtcctggggaacccggcccccatcccccgacacgcgcccatcccccgctactctacgtacctcatgctgctgctcatcgtgtcgtacgcctctgcatgcagcgagttgatccaggcgtccagcaggatcacaacctgcagcaccgagggcgtcaacacgaagtgccgcctgagtggaaccgccctcatccgggcgggctccgttggcgctgaggcctgcctgatgttaaagggggtaaaggaagaccaaaccaaattcttgaagatcaagaccgtcagctccgaactgagctgccgagaaggccagtcctactggacggggtctttcagtcccaagtgcctgagctcccgacgctgccatctcgtcggtgagtgccacgtcaaccgctgcctctcatggcgggacaacgagacatccgccgagttctcatttgtgggcgagtccaccaccatgcgcgagaacaagtgctttgagcagtgcggtggctggggctgcggatgcttcaacgtcaacccctcctgcctgttcgtccatacgtacctgcagagcgtgcggaaggaggccctcagggtcttcaactgcatcgactgggtgcacaagctgaccctggagatcaccgacttcgacggctctgtgtccaccattgacttgggcgcgtccagcagcagatttacgaactggggcagcgtcagtctcagcctggacgccgaggggatctccggcagtaactccttctcgttcatcgagtccccggggaagggctacgccatcgtagacgagcccttctcagagatcccccgccaggggtttctcggcgagattcgctgcaactccgaaagctcagttttgagcgcccacgaaagctgtctgcgcgcgcctaacctcatctcctacaagcccatgatcgaccagctggagtgcacgaccaacctgatcgaccccttcgtggtcttcgagcggggcagcctcccccagacccgcaacgacaagaccttcgccgcctcaaaagggaacaggggcgtgcaagccttctcaaaggggtccgtacaagccgaccttacgctgatgttcgacaactttgaggttgacttcgtgggcgcggccgttagctgcgacgccgcgtttctcaacctgaccggatgttacagttgcaatgcgggggcacgcgtctgcctttctatcaccagcaccggcacggggagcctctccgcccacaacaaggacggctcgctacacatcgtattaccgagcgagaacgggaccaaggaccagtgccagattctccacttcaccgtaccggaggtggaggaggagttcatgtactcctgcgacggtgacgaacggcccctactggtaaaagggaccctaatcgccatcgaccccttcgacgaccgccgcgaggcgggcggcgagtccacggtcgtgaaccccaaaagcgggtcctggaacttcttcgactggttcagcggcctgatgagctggttcgggggcccgttaaagactatcctccttatttgcctgtatgtggcgctcagcatcggcctgttctttttattaatatacctggggcgcaccggcctgagcaagatgtggctcgcggctacaaagaaggcctcctga

SEQ ID NO: 17278 - RNA, 1668 nt, synthetic construct
  misc_feature 1..1668: note = derived and/or modified CDS sequence (opt11) from RVFV(ZH-548)__DQ380206.1__IgE-leader_Gn(delSP)-variant1
  source 1..1668: mol_type = other RNA
atggactggacctggatcctcttcctagtcgccgcagccacccgcgtccactccgaagacccacacctacggaaccgcccaggaaaaggacacaactacattgacggcatgacccaagaggacgcaacctgcaaaccagtaacatacgccggcgcctgctcctccttcgacgtcctcctagaaaaaggcaaattcccactattccaatcctacgcccaccaccgaacactgctcgaagccgtacacgacaccatcatagcaaaagccgacccaccttcctgcgacctcctctccgcccacggcaacccctgcatgaaggaaaaactcgtcatgaagacccactgccccaacgactaccagagcgcccactacctcaacaacgacggcaagatggctagcgtcaagtgtcccccaaaatacgaactcactgaagactgcaacttctgccgccaaatgacaggggcatctctcaagaaaggctcctacccactccaagacctgttctgccaatcaagcgaagacgacggatccaaactcaaaaccaaaatgaaaggagtctgcgaagttggcgtccaagccctcaagaaatgcgatggccaactatcaacagctcacgaagtcgtccccttcgccgtcttcaaaaactctaagaaagtctacctcgacaaactcgacctcaaaaccgaagaaaacctactccccgattcattcgtctgcttcgaacacaaaggccagtacaaaggaaccatggactcaggccaaacaaaacgcgaactaaaatcattcgacatctcacaatgcccaaaaatcggtggacacggctcaaagaaatgcaccggagatgcggccttctgcagcgcctacgaatgcaccgctcaatatgcaaacgcctactgctcccacgccaacggctcaggaatcgtccagatccaagtatccggagtctggaagaaacccctatgcgtcggctacgaacgcgtagtagtaaaacgagaactctccgccaaacctatacaacgcgtagaaccctgcacaacatgcataacaaaatgcgagccccacggcctagtcgtccgctccaccggattcaaaatttcctctgcagtcgcatgcgcctcaggagtctgcgtcacaggctcacaatcgccctcaaccgaaatcactctcaaatacccaggcatcagccaaagctccggcggagacatcggagtccacatggcccacgacgaccaatccgtctccagcaaaatagtggcacactgccctccacaggatccctgcctcgttcacgactgcatcgtctgcgcccacggcctcataaactaccaatgccacaccgccctctccgcgttcgtcgtcgttttcgtattctcgtccatcgcaatcatctgccttgcaatcctctaccgggtcctcaaatgtctaaaaatcgcaccccgaaaagtcctcaaccctctaatgtggataacagccttcataagatggatctacaagaaaatggtcgcccgcgtagccgacaacatcaaccaggtcaaccgagaaatcggctggatggaaggaggccaactcgtcctcggcaacccagcccctatcccacgacacgcacccatcccccgctactccacctacctcatgctcctactcatagtatcctacgcctccgcctag

SEQ ID NO: 17279 - RNA, 1662 nt, synthetic construct
  misc_feature 1..1662: note = derived and/or modified CDS sequence (opt11) from RVFV(ZH-548)__DQ380206.1__IgE-leader_Gn(delSP)-variant2
  source 1..1662: mol_type = other RNA
atggactggacctggatcctcttcctcgtcgctgcagcaacacgcgtccactcgccacaccttcgcaacagaccaggcaaaggccacaactacatagacggaatgacacaagaagacgcaacctgcaaacccgtcacatacgccggcgcatgctcatccttcgacgtcctactagaaaagggcaaattccccctattccaatcctacgcccaccaccgaaccctcctagaagccgtccacgacaccatcatagcaaaggccgatcctccctcctgcgacctgctgtcagcacacggcaatccctgcatgaaagaaaagctagtcatgaaaacacactgccccaacgactaccaaagcgcccactatctcaacaacgacggcaaaatggcatcagtcaaatgcccacccaaatacgaactgaccgaagactgtaacttctgccgccaaatgaccggcgcctctctcaagaaaggatcataccccctccaagacctattctgccaatccagtgaagacgacggatccaaactcaaaaccaaaatgaaaggcgtctgcgaagttggagtgcaggccctcaagaaatgcgacggccaactttccaccgcccatgaggtagtacccttcgccgtattcaaaaactcgaagaaagtatacctagacaaactcgacttaaaaaccgaagaaaacctcctccccgactcattcgtctgcttcgaacacaaaggccaatacaaaggcaccatggactccggacaaaccaaacgcgaactcaaatccttcgacatcagccaatgtcccaaaataggaggacacggcagcaagaaatgcaccggcgacgccgcattttgctcagcctacgaatgcacagcacaatacgcaaacgcatactgctcacacgcaaacggctccggaatcgtccaaatccaagtatccggtgtttggaagaaacccctctgcgtcggatacgaacgcgtcgttgtcaaaagagaactctcagccaaaccaatccaacgcgtcgaaccctgcacaacctgcatcaccaaatgcgaacctcacgggctagtcgtccgatccaccggtttcaaaatctcaagcgccgtcgcctgtgccagcggtgtatgcgtaaccggatcccaatctccatcaaccgaaatcactctaaaataccccggaataagccagtcctccggaggagacataggcgtccacatggcacacgacgaccaatcagtctcatccaaaatagtagcacactgcccgccacaagacccatgcctagtccacgattgcatcgtctgcgcccacggcctaatcaactatcaatgccacaccgcactcagcgcattcgtggtcgtcttcgtcttctccagcatcgcaatcatatgcctcgccatcctctaccgcgtactcaaatgcctaaaaatagcccctcgaaaagttctcaaccccctcatgtggatcaccgcttttatccgatggatctacaagaaaatggtagctcgagtcgccgataacatcaaccaagtaaaccgcgaaatcggatggatggaaggcggccaactcgtcctaggaaatccggcccccatacctagacacgcacccatccctcgctactcaacctaccttatgctactccttatagtatcttacgcatccgcttga

SEQ ID NO: 17280 - RNA, 1578 nt, synthetic construct
  misc_feature 1..1578: note = derived and/or modified CDS sequence (opt11) from RVFV(ZH-548)__DQ380206.1__IgE-leader_Gc
  source 1..1578: mol_type = other RNA
atggactggacatggatcctcttcctcgtggccgcagccacaagagtccactcgtgctccgaacttatccaagcctccagccgaatcacaacctgcagcaccgaaggcgtaaataccaaatgccgactctccggcaccgccctaatccgcgcaggctcagtaggcgccgaagcctgccttatgctcaaaggagtcaaagaagaccaaaccaaattcctcaaaatcaagaccgtaagcagcgaactaagctgccgagaaggccagagctattggacaggctcattctcacccaaatgcctcagttcccgcagatgccacctagtcggcgaatgccacgtcaaccggtgcctctcatggcgggacaacgaaaccagcgcggaatttagcttcgtaggagaatcaactaccatgcgagaaaataagtgcttcgagcaatgcggcggctggggatgcggctgcttcaacgtaaacccctcatgcctattcgtccacacatacctccaatccgtccgcaaggaagccctacgcgtctttaactgcattgactgggtgcacaaacttacactcgaaatcacggacttcgacggcagcgtcagcacaatagacctcggcgcctccagctcccgcttcaccaattggggctccgtaagcctctccctggacgcagaaggcatctcaggctccaattcgttctccttcatagaatcacctgggaaaggctacgccatcgtagacgaacccttcagcgaaattccacgccaaggcttcctaggagaaatccgctgcaactctgaatcaagcgtactctccgcccacgaatcctgtctacgcgcccccaatctaatcagctacaaacccatgattgaccaactcgaatgcacaaccaatttaatcgacccatttgtcgtcttcgagcgcggatcactaccacaaacccgaaacgacaaaaccttcgcagcaagcaagggaaaccgcggtgtacaagccttcagcaaaggctccgtccaagcagaccttacactaatgttcgacaacttcgaagtcgacttcgtcggcgccgccgtcagctgcgacgccgccttcctgaacctcacgggctgttacagctgcaacgccggcgcacgcgtctgcctatctatcacctcgaccggcacaggatcactatccgcacacaacaaagacggatcgctccacatcgtactcccaagcgaaaacggcaccaaggaccagtgccaaatcctgcacttcaccgtaccagaagtagaagaagagttcatgtactcatgcgacggcgacgaaagaccactgctcgtgaaaggcacccttatagcgatcgacccattcgacgaccgacgagaagcaggaggcgaatcaacagttgtaaaccccaaaagcggaagttggaacttcttcgactggttcagcgggctcatgagctggttcggaggaccactcaaaaccatactcctcatctgcctctacgtcgcactcagcatcgggcttttcttcctcctcatctacctgggccgcaccggactatcaaaaatgtggctcgccgccaccaagaaagcaagctaa

SEQ ID NO: 17281 - RNA, 955 nt, synthetic construct
  misc_feature 1..955: note = mRNA product Design1 comprising derived and/or modified sequence from RVFV(ZH-548)__DQ380151.1__N (wt)
  source 1..955: mol_type = other RNA
gggagaaagcttaccatggacaactatcaagagcttgcgatccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagaattcttgaaagcctttggacttgtggattccaatgggaagccgtcagctgctgtcatggcagccgctcaggcttacaagacagcagcctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17282 - RNA, 955 nt, synthetic construct
  misc_feature 1..955: note = mRNA product Design1 comprising derived and/or modified sequence from RVFV(ZH-548)__DQ380151.1__N (wt)
  source 1..955: mol_type = other RNA
gggagaaagcttaccatggacaactatcaagagcttgcgatccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagagttcttgaaagcctttggacttgtggattccaatgggaagccgtcagctgctgtcatggcagccgctcaggcttacaagacagcagcctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17283 - RNA, 3811 nt, synthetic construct
  misc_feature 1..3811: note = mRNA product Design1 comprising derived and/or modified sequence from RVFV(ZH-548)__DQ380206.1__GP (wt)
  source 1..3811: mol_type = other RNA
gggagaaagcttaccatgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17284 - RNA, 3811 nt, synthetic construct
  misc_feature 1..3811: note = mRNA product Design1 comprising derived and/or modified sequence from RVFV(ZH-548)__DQ380206.1__GP (wt)
  source 1..3811: mol_type = other RNA
gggagaaagcttaccatgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgtcatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17285 - RNA, 3421 nt, synthetic construct
  misc_feature 1..3421: note = mRNA product Design1 comprising derived and/or modified sequence from RVFV(ZH-548)__DQ380206.1__Gn-Gc (wt)
  source 1..3421: mol_type = other RNA
gggagaaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17286 - RNA, 3421 nt, synthetic construct
  misc_feature 1..3421: note = mRNA product Design1 comprising derived and/or modified sequence from RVFV(ZH-548)__DQ380206.1__Gn-Gc (wt)
  source 1..3421: mol_type = other RNA
gggagaaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17287 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (wt)
  source 1..3172: mol_type = other RNA
gggagaaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctatggcagggattgcaatgacagtccttccagccttagcagtttttgctttggcacctgttgtttttgctgaagactgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17288 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (wt)
  source 1..3172: mol_type = other RNA
gggagaaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctatggcagggattgcaatgacagtccttccagccttagcagtttttgctttggcacctgttgtttttgctgaagactgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17289 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (wt)
  source 1..3406: mol_type = other RNA
gggagaaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17290 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (wt)
  source 1..3406: mol_type = other RNA
gggagaaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17291 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (wt)
  source 1..3400: mol_type = other RNA
gggagaaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17292 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (wt)
  source 1..3400: mol_type = other RNA
gggagaaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17293 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (wt)
  source 1..1885: mol_type = other RNA
gggagaaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17294 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (wt)
  source 1..1885: mol_type = other RNA
gggagaaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17295 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (wt)
  source 1..1879: mol_type = other RNA
gggagaaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17296 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (wt)
  source 1..1879: mol_type = other RNA
gggagaaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17297 - RNA, 1795 nt, synthetic construct
  misc_feature 1..1795: note = mRNA product Design1 comprising derived and/or modified sequence from RVFV(ZH-548)__DQ380206.1__IgE-leader_Gc (wt)
  source 1..1795: mol_type = other RNA
gggagaaagcttaccatggactggacctggatcctgttcctcgtggccgccgcgacccgcgtccacagctgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17298 - RNA, 1795 nt, synthetic construct
  misc_feature 1..1795: note = mRNA product Design1 comprising derived and/or modified sequence from RVFV(ZH-548)__DQ380206.1__IgE-leader_Gc (wt)
  source 1..1795: mol_type = other RNA
gggagaaagcttaccatggactggacctggatcctgttcctcgtggccgccgcgacccgcgtccacagctgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17299 - RNA, 955 nt, synthetic construct
  misc_feature 1..955: note = mRNA product Design1 comprising derived and/or modified sequence from RVFV(ZH-548)__DQ380151.1__N (opt4)
  source 1..955: mol_type = other RNA
gggagaaagcttaccatggacaactaccaggagctggccatccagttcgccgcccaggccgtggacagaaacgagatcgagcagtgggtgagagagttcgcctaccagggcttcgacgccagaagagtgatcgagctgctgaagcagtacggcggcgccgactgggagaaggacgccaagaagatgatcgtgctggccctgaccagaggcaacaagcccagaagaatgatgatgaagatgagcaaggagggcaaggccaccgtggaggccctgatcaacaagtacaagctgaaggagggcaaccccagcagagacgagctgaccctgagcagagtggccgccgccctggccggctggacctgccaggccctggtggtgctgagcgagtggctgcccgtgaccggcaccaccatggacggcctgagccccgcctaccccagacacatgatgcaccccagcttcgccggcatggtggaccccagcctgcccggcgactacctgagagccatcctggacgcccacagcctgtacctgctgcagttcagcagagtgatcaaccccaacctgagaggcagaaccaaggaggaggtggccgccaccttcacccagcccatgaacgccgccgtgaacagcaacttcatcagccacgagaagagaagagagttcctgaaggccttcggcctggtggacagcaacggcaagcccagcgccgccgtgatggccgccgcccaggcctacaagaccgccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17300 - RNA, 3811 nt, synthetic construct
  misc_feature 1..3811: note = mRNA product Design1 comprising derived and/or modified sequence from RVFV(ZH-548)__DQ380206.1__GP (opt4)
  source 1..3811: mol_type = other RNA
gggagaaagcttaccatgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgtcacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17301 - RNA, 3421 nt, synthetic construct
  misc_feature 1..3421: note = mRNA product Design1 comprising derived and/or modified sequence from RVFV(ZH-548)__DQ380206.1__Gn-Gc (opt4)
  source 1..3421: mol_type = other RNA
gggagaaagcttaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17302 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (opt4)
  source 1..3172: mol_type = other RNA
gggagaaagcttaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccatggccggcatcgccatgaccgtgctgcccgccctggccgtgttcgccctggcccccgtggtgttcgccgaggactgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17303 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (opt4)
  source 1..3406: mol_type = other RNA
gggagaaagcttaccatggactggacctggatcctgttcctggtggccgccgccaccagagtgcacagcgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17304 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (opt4)
  source 1..3400: mol_type = other RNA
gggagaaagcttaccatggactggacctggatcctgttcctggtggccgccgccaccagagtgcacagcccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17305 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (opt4)
  source 1..1885: mol_type = other RNA
gggagaaagcttaccatggactggacctggatcctgttcctggtggccgccgccaccagagtgcacagcgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17306 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (opt4)
  source 1..1879: mol_type = other RNA
gggagaaagcttaccatggactggacctggatcctgttcctggtggccgccgccaccagagtgcacagcccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17307 - RNA, 1795 nt, synthetic construct
  misc_feature 1..1795: note = mRNA product Design1 comprising derived and/or modified sequence from RVFV(ZH-548)__DQ380206.1__IgE-leader_Gc (opt4)
  source 1..1795: mol_type = other RNA
gggagaaagcttaccatggactggacctggatcctgttcctggtggccgccgccaccagagtgcacagctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17308 - RNA, 955 nt, synthetic construct
  misc_feature 1..955: note = mRNA product Design1 comprising derived and/or modified sequence from RVFV(ZH-548)__DQ380151.1__N (opt3)
  source 1..955: mol_type = other RNA
gggagaaagcttaccatggacaactaccaggagctggccatccaattcgctgcacaggccgtggatagaaatgaaattgagcagtgggtcagggaatttgcgtatcagggcttcgacgctcggcgcgttatagagctccttaagcaatacgggggagccgattgggaaaaagacgcaaagaaaatgatcgtgctggccttgacccgaggtaacaagccccgtagaatgatgatgaaaatgagcaaggagggcaaggctacagtagaggcattaattaataaatataagctgaaagaagggaacccttccagggatgagctaactctctctcgggtggccgctgccctggcgggatggacgtgccaggcacttgtcgtgctgtcagaatggttgccagttaccggcacaactatggacggtctcagtccggcctacccccgccacatgatgcatcctagctttgctgggatggtggatccatccctgcccggagactatctgagagccatcctcgatgcacactctttatacctgcttcagttctcgagggtcattaatcctaacttgcggggccgcaccaaggaggaggtggctgccacatttacccagccaatgaatgcggccgtaaactcaaatttcatcagccatgaaaaacgaagagagtttctgaaggcattcggcctagttgacagtaacgggaagccctccgctgccgtgatggctgccgcacaagcctataaaactgctgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17309 - RNA, 3811 nt, synthetic construct
  misc_feature 1..3811: note = mRNA product Design1 comprising derived and/or modified sequence from RVFV(ZH-548)__DQ380206.1__GP (opt3)
  source 1..3811: mol_type = other RNA
gggagaaagcttaccatgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgctgtcagcccacggaaatccgtgcatgaaggagaagctagtcatgaaaacgcattgtcccaacgattatcagagtgcgcactacctcaataacgacggtaagatggccagcgtgaaatgccctccaaagtatgaactgactgaggactgtaatttctgccgacaaatgaccggcgcatctcttaaaaaggggtcctaccccctgcaggatttgttttgccagtcaagcgaagacgatggaagtaaactcaagacaaagatgaaaggcgtgtgtgaggtcggtgttcaggctctgaagaaatgcgacgggcaattatctactgcccatgaagtggtacctttcgctgtgtttaagaactccaaaaaggtctacctggataagctcgaccttaaaaccgaggagaatctgttgccagatagcttcgtgtgttttgaacacaagggacagtataaaggcacaatggactcgggccagaccaagagagagctaaaatctttcgatatttcccagtgccccaagatcgggggacacggttcaaagaaatgtacgggcgacgccgcattttgcagtgcctacgaatgtactgctcaatatgcgaacgcatactgcagccatgccaatgggtccggaatcgttcagattcaggtgtctggcgtctggaagaaaccgctgtgtgtgggttatgagagggtagttgtgaagcgggaactcagcgctaaacctatacaacgtgtcgagccctgcacaacctgtatcactaagtgcgagccacacgggctggtggtccgctcaacaggcttcaagattagttccgccgtggcatgcgccagcggagtttgtgtgaccggctctcagtcacctagtacggaaatcacccttaaataccccgggataagccagtcctctggaggtgatattggcgtacatatggctcacgacgaccagtcggtcagctccaagatcgtggcccattgcccaccccaagatccttgtctggttcacgactgcatcgtgtgtgcacacgggttgattaactatcagtgccatacagcgctctcagctttcgtcgtggtatttgtgttcagttctatcgccattatatgtctggcaatcttatacagagttctgaaatgcctaaagattgccccaaggaaagtcctcaatccgctgatgtggatcactgcttttatccggtggatttacaagaaaatggtggcccgagtggcagataacataaaccaggtcaatcgcgagatcggatggatggaaggcggtcagcttgttttggggaaccccgctcctattccaagacacgcccccatccctaggtatagcacctacctgatgctcctgcttattgtgtcctatgcgtcagcctgtagcgagctgatccaggcttcttcccggataacaacttgcagtaccgagggcgtgaatacaaagtgtcgcttgagcggaaccgcactcatcagagccggctctgtaggggctgaagcctgcctgatgttaaagggagtcaaagaggaccaaactaagttcctgaaaattaagacggtgtcctcagaactaagttgcagggagggtcagagctactggacaggctcgttttccccaaaatgtctctctagccgtcggtgccatctggttggggaatgtcacgtgaaccgatgcctttcatggagagataatgagaccagtgcagagttctcctttgtcggagaatctactaccatgagggagaacaagtgtttcgaacagtgcggcggttgggggtgtggctgctttaatgtgaaccccagctgtttgttcgttcacacatatctgcaatccgtgcgcaaggaggcgctccgggtatttaattgcatcgactgggtccataaactgaccttagaaattactgatttcgacggatcagtgagcacaatcgatctgggcgccagttcttccagatttacgaactgggggagcgtgtcgctttcattggacgctgagggaatatctggcagtaattccttcagcttcattgagtctccgggtaaggggtacgccatcgtcgatgaaccttttagcgagattccaaggcagggattcctcggcgaaatccgctgtaactccgagtcaagtgttctgagcgcacacgaatcttgcctacgagctcccaatctgatatcctataaacctatgatcgaccagctcgagtgcaccactaacctgattgatccctttgtggtattcgagcggggttcacttccacagacacgtaatgacaagacctttgccgcaagtaaaggcaacagaggggtgcaagccttcagcaagggatccgtccaggctgacttgacactgatgtttgataacttcgaagtggactttgttggcgcggccgtgtcttgtgatgcagctttcttaaatctcactgggtgctactcgtgtaacgccggagccagggtctgcctgagcatcacctcaacgggcaccggttcccttagtgctcataataaggacgggtctctgcacattgtgttgcctagcgagaacggaacaaaagatcagtgtcaaatcctccattttactgttcccgaagtggaggaggagttcatgtactcctgcgacggcgatgagcgcccactgctagtcaagggtaccctgatagcaattgacccgtttgatgaccggagagaagccggcggggagtcaacagtagtgaatcctaaatctggaagctggaacttcttcgattggtttagtggcctcatgtcctggttcgggggacccctgaagactatccttttgatctgtctgtatgttgcgttaagcattggcctctttttcctgcttatctacctgggtaggaccgggctatctaaaatgtggctcgctgccacgaagaaggcatcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17310 - RNA, 3421 nt, synthetic construct
  misc_feature 1..3421: note = mRNA product Design1 comprising derived and/or modified sequence from RVFV(ZH-548)__DQ380206.1__Gn-Gc (opt3)
  source 1..3421: mol_type = other RNA
gggagaaagcttaccatggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctctcagtgccttcgtggttgtgttcgtattttccagcattgcaatcatctgccttgccattctgtaccgcgtcttgaagtgtctaaaaatagctcctagaaaggtgctgaaccccctcatgtggatcaccgccttcattaggtggatctataaaaagatggttgcacgggtggcggacaatataaaccaagtcaatcgcgaaattggctggatggagggaggccagctggtgcttgggaacccagctcccatccctcgacacgccccaatcccgagatactctacttacctgatgttgctcctgattgtatcatatgcaagtgcctgcagcgaattaatccaggcttcctctaggattacaacctgttcgacggagggagtgaacaccaagtgccggctgagcggtacagccctaatacgtgcaggctccgttggggctgaagcctgtctcatgctgaaaggagtcaaggaggatcagactaaatttcttaagatcaaaaccgtgtcaagtgagttgtcttgccgcgaaggccaaagctactggacaggttccttctcacccaagtgtctgagctctagaaggtgccatctcgtgggggagtgtcacgtcaatcggtgcctgtcctggcgagacaacgaaaccagtgcggagtttagcttcgttggcgaatctactacaatgcgcgagaataaatgctttgagcagtgtggaggctgggggtgcggatgtttcaacgtgaatccttcctgcctttttgtgcatacctatctgcagtcagtaagaaaggaagccttgagggtcttcaactgtattgactgggtgcacaagctcactctggagatcacggattttgacggtagtgttagcacaatcgatttaggcgcttcgtcctctcggttcaccaattgggggagcgtgtcactgagtctagacgcagaaggaatttccggctctaacagcttttccttcatagagtcaccaggtaaagggtacgccatcgtcgatgagcccttcagcgaaattcctcgccagggctttctcggagagatcagatgcaatagtgaatcttccgtgctgagcgctcacgagtcgtgtcttagggccccaaacttgatttcatataagcccatgatcgaccaactggaatgcactaccaatctcatagatccgttcgttgtgtttgagcgtggctctctgcctcagacacggaacgacaaaaccttcgcagcgagtaaggggaatcgaggagtacaggccttttccaaaggcagcgtccaggctgatttaactctgatgttcgacaactttgaggtggatttcgtgggtgccgcagtctcttgtgacgctgcctttcttaatttgacagggtgctacagctgtaacgcaggagccagagtttgcctctccatcacgtcaaccggcactggtagtctgagcgctcataacaaggatggctctctacacattgtgctgccatccgaaaatgggacaaaggaccaatgccagatcctccatttcaccgtacccgaggtggaagaggaatttatgtattcatgtgacggagatgagaggcctctgcttgtcaaaggcacattgattgcgatcgaccccttcgatgaccgccgggaggccgggggagaaagtactgtggttaacccaaagagcggctcctggaactttttcgattggttctctggtctgatgtcgtggtttgggggacctttaaaaaccatactcctgatttgcctttacgtggcactgagcatcggcttgttctttctcctgatttacctaggtagaacgggcctgtcaaagatgtggctcgctgccaccaaaaaggcctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17311 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (opt3)
  source 1..3172: mol_type = other RNA
gggagaaagcttaccatggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctatggccggcattgcaatgaccgtgctccctgcccttgctgttttcgccctggcacccgtggtattcgcggaagactgcagtgagttgatccaagctagcagccgcatcactacatgttctaccgaaggagtcaacacgaagtgcagactatcaggcaccgccctgattagggcagggagtgtgggagccgaggcttgtctcatgctgaaaggtgttaaggaagatcagacaaaatttcttaagataaagactgtgagctccgagctgtcttgccgggagggccagtcgtactggaccgggagcttctccccaaaatgtttgtcaagtcgccgatgccacctcgtcggagaatgtcatgtgaatagatgcctgtcttggagggacaacgagacaagcgccgaattttccttcgtaggcgagtcaactaccatgcgggaaaataagtgttttgagcagtgcggtgggtggggctgcggatgtttcaacgtgaaccccagctgcttatttgttcacacatatctgcaatctgtccgtaaagaggcactacgcgtgttcaattgtatcgactgggtgcataagctcaccctggaaattactgattttgacggctccgtcagtacgatcgatcttggggcttcctcttccagattcacaaactggggatcagttagtttgagcctggacgccgagggtatatcgggctccaattcttttagcttcattgaatcacctgggaaaggatacgcgatcgtggatgagccatttagtgagatcccgaggcagggcttcctcggtgaaattcggtgcaactccgagtctagcgtgctgtccgcccacgaatcatgtcttcgagctcccaatctgatcagctacaagcctatgattgaccagttggagtgcaccactaacctcatagatccattcgtagtctttgaacgcgggagtctgccccagaccagaaatgacaaaacattcgcagcctctaagggcaacaggggagtgcaggctttttccaagggcagcgttcaagccgatttaaccctgatgttcgacaattttgaggtggatttcgtcggggcagcggtgtcgtgtgacgccgcttttctaaacctcactggatgctattcatgtaatgccggcgcacgggtttgcctgtctatcacaagtacgggtaccgggtcccttagcgctcacaacaaagatggatctttgcatattgtgctgcctagcgagaatggcactaaggaccagtgtcagatcctccacttcacagtaccagaagtcgaggaagagtttatgtactcctgcgacggtgatgaacgccccctgttagtgaaaggcaccctgatcgccattgacccgttcgatgacagaagggaggcagggggagagtcaacagtggtcaaccctaagagtggcagctggaactttttcgattggttttctgggcttatgtcctggttcggaggcccattgaaaactatactcctgatctgcctatatgttgccctgtcaattggtctcttctttctgcttatctacttggggcgtaccggactgagtaagatgtggttagctgcgacgaagaaagccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17312 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (opt3)
  source 1..3406: mol_type = other RNA
gggagaaagcttaccatggactggacatggatcctgttcctcgtggccgctgcaacaagagtccacagcgaggatccccatcttaggaaccggcctggcaaggggcacaattacattgacggaatgactcaggaagatgccacgtgcaaaccagttacctatgcgggtgcttgttcctcttttgacgtgctgttggagaagggcaaattcccgttatttcaatcatacgcccatcaccgcacactgctagaagcagtacatgatactataatcgccaaggctgatccccctagttgcgacctcctgagcgcacacgggaacccatgtatgaaagagaaacttgtgatgaagacccactgccccaatgactatcagtccgcccattacctgaacaatgatggaaaaatggcttctgtcaagtgtcctccaaaatatgaattgacagaggactgcaacttctgtcgacagatgaccggcgcctcgctcaagaaaggttcataccccctgcaggatctgttttgccaaagcagtgaggacgatgggtccaagctcaagactaaaatgaagggagtgtgtgaagttggcgtgcaggcgttaaagaagtgcgacggccagctgtctacagcacacgaggtcgtgcctttcgccgtatttaaaaatagcaagaaagtttatcttgacaagttggatctgaagaccgaagagaacctactcccagactccttcgtgtgttttgagcataaagggcagtacaagggaacgatggattcaggtcaaactaaacgtgaactgaagagtttcgacattagccagtgcccgaaaatcggcgggcacggatctaagaagtgcaccggcgatgctgccttttgttccgcatacgagtgcacagctcagtatgccaatgcgtactgttcacacgccaacggtagcgggattgtccagatccaagtgagtggagtgtggaaaaagcccctttgcgtcggctatgaaagagttgtggtaaaaagggagctgtctgcaaagcctatacagcgggtggaaccatgtactacctgcatcacaaaatgtgagccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagacatcggcgtgcacatggcccatgatgaccagagcgtatcaagtaaaatagttgcacactgtcccccgcaggatccttgcctggtgcatgactgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgataatataaaccaagttaatcgagaaattgggtggatggagggcggacagctcgtgctgggcaaccctgctcccatcccaagacatgcccccatccctaggtactcaacataccttatgctgttgctcattgtcagttatgcaagcgcgtgctccgaactgatccaggcttcttcgcggattaccacgtgtagcaccgagggggtgaacacaaagtgccgtttatccggaactgccctgatacgcgcaggttcagtaggcgccgaggcttgtctaatgctcaaaggggtgaaggaagaccagaccaaattcctgaagatcaaaacagttagttctgagcttagctgcagagaaggacaatcctactggactggctcatttagcccaaagtgtttgtcttccaggcggtgccacctggtcggtgagtgtcatgtgaatcgatgcctcagttggcgcgacaacgaaaccagcgccgagttctcttttgtgggggaatccacaaccatgagagagaataaatgcttcgagcagtgtggcggatggggctgcgggtgttttaacgtcaatccgtcatgcctgttcgttcacacttatcttcagagtgtgaggaaggaagcactgcgggtgtttaactgtattgattgggtacacaagttgacgctcgagatcacagacttcgatggaagcgtctcgaccatcgacctgggtgcttcctctagccgctttactaattggggctcagtgagtttatccctggatgccgaagggatttctggaagcaactccttctcatttatagagagccccggcaaaggttacgcgatcgttgacgagcctttcagtgaaattccaagacaggggttcctaggcgagatcaggtgcaattctgaatccagcgtgctctcggcccatgagtcatgtctgcgtgctcccaaccttatttcttataagcctatgatcgatcaattggaatgcaccacaaatctgatagacccatttgtcgtgttcgagcggggaagtctcccccagacccgaaacgataaaacttttgcagcctccaagggcaatagaggggttcaggctttcagcaaaggatctgtgcaggccgacctgacattaatgtttgataacttcgaggtagactttgtcggcgcagcggtgagctgtgatgccgctttcctgaatcttacgggttgctactcctgtaacgccggggcaagggtgtgcttgtcaatcaccagtactggaacaggcagcctctctgctcacaacaaggacggttccctgcatattgtcctaccgtcagaaaatggcaccaaggaccaatgccagatcctgcactttacagttcctgaggtggaagaggagttcatgtatagttgtgatggggacgaacgcccactcctggtaaaaggaactcttattgccatcgatccctttgacgatcggagagaggcaggcggggaaagcaccgtggtcaaccctaagtccggatcttggaatttctttgactggttctcgggcttgatgagctggttcggtgggcccctgaaaacgatattactcatttgcctgtacgtggccctttcaatcggactgtttttcttgctcatttacctgggcaggaccggtctatccaagatgtggctggctgcgaccaaaaaggccagttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17313 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (opt3)
  source 1..3400: mol_type = other RNA
gggagaaagcttaccatggactggacatggatcctgttcctcgtggccgctgcaacaagagtccacagcccccatcttaggaaccggcctggcaaggggcacaattacattgatggaatgactcaggaggacgccacgtgcaaaccagttacctatgcgggtgcttgttcctcttttgatgtgctgttggaaaagggcaaattcccgttatttcaatcatacgcccatcaccgcacactgctagaggcagtacatgacactataatcgccaaggctgatccccctagttgcgacctcctgagcgcacacgggaacccatgtatgaaagaaaaacttgtgatgaagacccactgccccaatgattatcagtccgcccattacctgaacaatgacggaaaaatggcttctgtcaagtgtcctccaaaatatgagttgacagaagattgcaacttctgtcgacagatgaccggcgcctcgctcaagaaaggttcataccccctgcaggacctgttttgccaaagcagtgaggatgacgggtccaagctcaagactaaaatgaagggagtgtgtgaggttggcgtgcaggcgttaaagaagtgcgatggccagctgtctacagcacacgaagtcgtgcctttcgccgtatttaaaaatagcaagaaagtttatcttgacaagttggacctgaagaccgaggaaaacctactcccagattccttcgtgtgttttgagcataaagggcagtacaagggaacgatggactcaggtcaaactaaacgtgagctgaagagtttcgatattagccagtgcccgaaaatcggcgggcacggatctaagaagtgcaccggcgacgctgccttttgttccgcatacgaatgcacagctcagtatgccaatgcgtactgttcacacgccaacggtagcgggattgtccagatccaagtgagtggagtgtggaaaaagcccctttgcgtcggctatgagagagttgtggtaaaaagggaactgtctgcaaagcctatacagcgggtggagccatgtactacctgcatcacaaaatgtgaaccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagatatcggcgtgcacatggcccatgacgatcagagcgtatcaagtaaaatagttgcacactgtcccccgcaggacccttgcctggtgcatgattgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgacaatataaaccaagttaatcgagagattgggtggatggaaggcggacagctcgtgctgggcaaccctgctcccatcccaagacatgcccccatccctaggtactcaacataccttatgctgttgctcattgtcagttatgcaagcgcgtgctccgagctgatccaggcttcttcgcggattaccacgtgtagcaccgaaggggtgaacacaaagtgccgtttatccggaactgccctgatacgcgcaggttcagtaggcgccgaggcttgtctaatgctcaaaggggtgaaggaagatcagaccaaattcctgaagatcaaaacagttagttctgagcttagctgcagagagggacaatcctactggactggctcatttagcccaaagtgtttgtcttccaggcggtgccacctggtcggtgaatgtcatgtgaatcgatgcctcagttggcgcgacaacgagaccagcgccgagttctcttttgtgggggaatccacaaccatgagagaaaataaatgcttcgagcagtgtggcggatggggctgcgggtgttttaacgtcaatccgtcatgcctgttcgttcacacttatcttcagagtgtgaggaaggaggcactgcgggtgtttaactgtattgactgggtacacaagttgacgctcgaaatcacagatttcgacggaagcgtctcgaccatcgatctgggtgcttcctctagccgctttactaattggggctcagtgagtttatccctggacgccgaggggatttctggaagcaactccttctcatttatagaaagccccggcaaaggttacgcgatcgttgatgagcctttcagtgagattccaagacaggggttcctaggcgaaatcaggtgcaattctgagtccagcgtgctctcggcccatgaatcatgtctgcgtgctcccaaccttatttcttataagcctatgatcgaccaattggagtgcaccacaaatctgatagatccatttgtcgtgttcgaacggggaagtctcccccagacccgaaacgacaaaacttttgcagcctccaagggcaatagaggggttcaggctttcagcaaaggatctgtgcaggccgatctgacattaatgtttgacaacttcgaggtagattttgtcggcgcagcggtgagctgtgacgccgctttcctgaatcttacgggttgctactcctgtaacgccggggcaagggtgtgcttgtcaatcaccagtactggaacaggcagcctctctgctcacaacaaggatggttccctgcatattgtcctaccgtcagagaatggcaccaaggaccaatgccagatcctgcactttacagttcctgaagtggaggaagagttcatgtatagttgtgacggggatgaacgcccactcctggtaaaaggaactcttattgccatcgacccctttgatgaccggagagaggcaggcggggagagcaccgtggtcaaccctaagtccggatcttggaatttctttgattggttctcgggcttgatgagctggttcggtgggcccctgaaaacgatattactcatttgcctgtacgtggccctttcaatcggactgtttttcttgctcatttacctgggcaggaccggtctatccaagatgtggctggctgcgaccaaaaaggccagttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17314 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (opt3)
  source 1..1885: mol_type = other RNA
gggagaaagcttaccatggactggacctggatcctgttcctcgtggccgctgcaacaagagtccacagcgaggatccccatcttaggaaccggcctggcaaggggcacaattacattgacggaatgactcaggaagatgccacgtgcaaaccagttacctatgcgggtgcttgttcctcttttgacgtgctgttggagaagggcaaattcccgttatttcaatcatacgcccatcaccgcacactgctagaagcagtacatgatactataatcgccaaggctgatccccctagttgcgacctcctgagcgcacacgggaacccatgtatgaaagagaaacttgtgatgaagacccactgccccaatgactatcagtccgcccattacctgaacaatgatggaaaaatggcttctgtcaagtgtcctccaaaatatgaattgacagaggactgcaacttctgtcgacagatgaccggcgcctcgctcaagaaaggttcataccccctgcaggatctgttttgccaaagcagtgaggacgatgggtccaagctcaagactaaaatgaagggagtgtgtgaagttggcgtgcaggcgttaaagaagtgcgacggccagctgtctacagcacacgaggtcgtgcctttcgccgtatttaaaaatagcaagaaagtttatcttgacaagttggatctgaagaccgaagagaacctactcccagactccttcgtgtgttttgagcataaagggcagtacaagggaacgatggattcaggtcaaactaaacgtgaactgaagagtttcgacattagccagtgcccgaaaatcggcgggcacggatctaagaagtgcaccggcgatgctgccttttgttccgcatacgagtgcacagctcagtatgccaatgcgtactgttcacacgccaacggtagcgggattgtccagatccaagtgagtggagtgtggaaaaagcccctttgcgtcggctatgaaagagttgtggtaaaaagggagctgtctgcaaagcctatacagcgggtggaaccatgtactacctgcatcacaaaatgtgagccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagacatcggcgtgcacatggcccatgatgaccagagcgtatcaagtaaaatagttgcacactgtcccccgcaggatccttgcctggtgcatgactgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgataatataaaccaagttaatcgagaaattgggtggatggagggcggacagctcgtgctgggcaaccctgctcccatcccaagacatgcccccatccctaggtactcaacataccttatgctgttgctcattgtcagttatgcaagcgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17315 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (opt3)
  source 1..1879: mol_type = other RNA
gggagaaagcttaccatggactggacctggatcctgttcctcgtggccgctgcaacaagagtccacagcccccatcttaggaaccggcctggcaaggggcacaattacattgatggaatgactcaggaggacgccacgtgcaaaccagttacctatgcgggtgcttgttcctcttttgatgtgctgttggaaaagggcaaattcccgttatttcaatcatacgcccatcaccgcacactgctagaggcagtacatgacactataatcgccaaggctgatccccctagttgcgacctcctgagcgcacacgggaacccatgtatgaaagaaaaacttgtgatgaagacccactgccccaatgattatcagtccgcccattacctgaacaatgacggaaaaatggcttctgtcaagtgtcctccaaaatatgagttgacagaagattgcaacttctgtcgacagatgaccggcgcctcgctcaagaaaggttcataccccctgcaggacctgttttgccaaagcagtgaggatgacgggtccaagctcaagactaaaatgaagggagtgtgtgaggttggcgtgcaggcgttaaagaagtgcgatggccagctgtctacagcacacgaagtcgtgcctttcgccgtatttaaaaatagcaagaaagtttatcttgacaagttggacctgaagaccgaggaaaacctactcccagattccttcgtgtgttttgagcataaagggcagtacaagggaacgatggactcaggtcaaactaaacgtgagctgaagagtttcgatattagccagtgcccgaaaatcggcgggcacggatctaagaagtgcaccggcgacgctgccttttgttccgcatacgaatgcacagctcagtatgccaatgcgtactgttcacacgccaacggtagcgggattgtccagatccaagtgagtggagtgtggaaaaagcccctttgcgtcggctatgagagagttgtggtaaaaagggaactgtctgcaaagcctatacagcgggtggagccatgtactacctgcatcacaaaatgtgaaccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagatatcggcgtgcacatggcccatgacgatcagagcgtatcaagtaaaatagttgcacactgtcccccgcaggacccttgcctggtgcatgattgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgacaatataaaccaagttaatcgagagattgggtggatggaaggcggacagctcgtgctgggcaaccctgctcccatcccaagacatgcccccatccctaggtactcaacataccttatgctgttgctcattgtcagttatgcaagcgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17316 - RNA, 1795 nt, synthetic construct
  misc_feature 1..1795: note = mRNA product Design1 comprising derived and/or modified sequence from RVFV(ZH-548)__DQ380206.1__IgE-leader_Gc (opt3)
  source 1..1795: mol_type = other RNA
gggagaaagcttaccatggactggacctggatcctgttcctcgtggccgctgcaacaagagtccacagctgctccgagcttattcaggcctcttcaaggataactacgtgtagtaccgaaggcgttaatacaaagtgccggctgagcgggactgcgttgatccgcgctggatccgtgggtgccgaggcatgtttaatgctgaaaggcgtaaaggaagatcaaaccaaatttctaaagattaaaacagtgtcttcggagctctcatgccgagaagggcagagctactggaccggaagtttctcccccaagtgtctgtctagccgtagatgccatcttgtcggcgagtgtcacgtgaataggtgcctgtcctggcgggacaacgagacttcagccgaatttagtttcgttggtgagagcacaaccatgcgcgaaaataagtgttttgagcagtgcgggggatggggctgtggctgcttcaacgtgaatccttcttgcttgtttgtccatacgtatctccagtccgtgagaaaagaggctctgagggtattcaactgtatcgattgggttcacaagctgactctcgaaattaccgactttgatgggtcagtgagcacaatcgacttaggagcaagttcttcccggttcactaattggggtagcgtctcgctgtctcttgatgccgagggcatatccgggtcaaacagttttagcttcatcgaatccccaggaaaaggctacgctattgtggacgagccgttttctgaaatcccccgccaaggtttcttgggggagattcgatgcaatagcgagtcaagtgtgctgtccgcccatgaaagctgtctaagagcgcctaacctcatctcttataagccaatgatagatcagctggagtgcaccacaaatcttattgaccccttcgtcgtttttgaaaggggatcactgcctcagacccggaacgataaaacgttcgcagccagtaagggcaatcgtggcgtgcaggcttttagcaaggggtccgtacaagccgacttgactctcatgttcgataactttgaggtggacttcgtcggagcagctgtgtcttgtgacgccgcgtttctgaatttaacaggttgctactcgtgtaacgccggcgcacgcgtttgcctgagcatcacctccactgggacaggatcactcagtgctcacaacaaagatggctctcttcacattgtgctgccaagcgaaaatggtaccaaggaccagtgtcagatcttgcatttcacggtccccgaggtggaggaagagtttatgtattcctgcgatggggacgaaagacctctactggtaaaaggcaccctcatcgccattgatccattcgacgataggcgggaggctggaggcgaatcaacagttgtgaacccgaaaagcgggtcttggaactttttcgactggttttccggactgatgagttggttcggtggcccccttaaaactatactgttgatctgtctctacgtcgccctgagcattgggttattctttctgctaatctatctcggacgaaccggcctgtctaagatgtggcttgcagccacaaagaaggcttcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17317 - RNA, 955 nt, synthetic construct
  misc_feature 1..955: note = mRNA product Design1 comprising derived and/or modified sequence from RVFV(ZH-548)__DQ380151.1__N (opt1)
  source 1..955: mol_type = other RNA
gggagaaagcttaccatggacaactaccaggagctggccatccagttcgccgcgcaggccgtggaccgcaacgagatcgagcagtgggtccgggagttcgcctaccagggcttcgacgcccgccgggtgatcgagctcctgaagcagtacgggggcgccgactgggagaaggacgcgaagaagatgatcgtgctggccctcacccgcgggaacaagccccggcgcatgatgatgaagatgagcaaggagggcaaggccaccgtcgaggccctgatcaacaagtacaagctgaaggaggggaacccgtcccgggacgagctcacgctgagccgcgtggcggccgccctggccggctggacctgccaggccctcgtggtcctgtccgagtggctgcccgtgaccggcaccacgatggacgggctcagccccgcgtacccccggcacatgatgcacccgtccttcgccggcatggtggaccccagcctgcccggggactacctgcgcgccatcctcgacgcccactccctgtacctgctccagttcagccgggtcatcaaccccaacctgcgcggccggaccaaggaggaggtggccgcgaccttcacccagccgatgaacgccgccgtgaactccaacttcatcagccacgagaagcgccgggagttcctgaaggccttcgggctcgtcgactccaacggcaagcccagcgccgcggtgatggccgccgcccaggcctacaagacggcggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17318 - RNA, 3811 nt, synthetic construct
  misc_feature 1..3811: note = mRNA product Design1 comprising derived and/or modified sequence from RVFV(ZH-548)__DQ380206.1__GP (opt1)
  source 1..3811: mol_type = other RNA
gggagaaagcttaccatgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17319 - RNA, 3421 nt, synthetic construct
  misc_feature 1..3421: note = mRNA product Design1 comprising derived and/or modified sequence from RVFV(ZH-548)__DQ380206.1__Gn-Gc (opt1)
  source 1..3421: mol_type = other RNA
gggagaaagcttaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17320 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (opt1)
  source 1..3172: mol_type = other RNA
gggagaaagcttaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccatggcggggatcgccatgaccgtgctgcccgccctggccgtgttcgcgctcgcccccgtcgtgttcgccgaggactgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17321 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (opt1)
  source 1..3406: mol_type = other RNA
gggagaaagcttaccatggactggacctggatcctgttcctcgtggccgccgcgacccgcgtccacagcgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17322 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (opt1)
  source 1..3400: mol_type = other RNA
gggagaaagcttaccatggactggacctggatcctgttcctcgtggccgccgcgacccgcgtccacagcccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17323 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (opt1)
  source 1..1885: mol_type = other RNA
gggagaaagcttaccatggactggacctggatcctgttcctcgtggccgccgcgacccgcgtccacagcgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17324 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (opt1)
  source 1..1879: mol_type = other RNA
gggagaaagcttaccatggactggacctggatcctgttcctcgtggccgccgcgacccgcgtccacagcccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17325 - RNA, 1795 nt, synthetic construct
  misc_feature 1..1795: note = mRNA product Design1 comprising derived and/or modified sequence from RVFV(ZH-548)__DQ380206.1__IgE-leader_Gc (opt1)
  source 1..1795: mol_type = other RNA
gggagaaagcttaccatggactggacctggatcctgttcctcgtggccgccgcgacccgcgtccacagctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17326 - RNA, 955 nt, synthetic construct; identical to SEQ ID NO: 17317
  misc_feature 1..955: note = mRNA product Design1 comprising derived and/or modified sequence from RVFV(ZH-548)__DQ380151.1__N (opt1)
  source 1..955: mol_type = other RNA

SEQ ID NO: 17327 - RNA, 3811 nt, synthetic construct; identical to SEQ ID NO: 17318
  misc_feature 1..3811: note = mRNA product Design1 comprising derived and/or modified sequence from RVFV(ZH-548)__DQ380206.1__GP (opt1)
  source 1..3811: mol_type = other RNA

SEQ ID NO: 17328 - RNA, 3421 nt, synthetic construct
  misc_feature 1..3421: note = mRNA product Design1 comprising derived and/or modified sequence from RVFV(ZH-548)__DQ380206.1__Gn-Gc (opt1)
  source 1..3421: mol_type = other RNA
gggagaaagcttaccatggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgccgacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcctgctccgagctgatccaggccagctcccgcatcacgacctgcagcaccgagggggtgaacaccaagtgccggctctccggcacggccctgatccgcgccggcagcgtgggggcggaggcctgcctgatgctcaagggcgtcaaggaggaccagaccaagttcctgaagatcaagaccgtgtccagcgagctgtcctgccgggaggggcagagctactggaccggctccttcagcccgaagtgcctgtccagccgccggtgccacctcgtgggcgagtgccacgtcaaccgctgcctgtcctggcgcgacaacgagacgagcgccgagttctccttcgtgggggagagcaccaccatgcgggagaacaagtgcttcgagcagtgcggcgggtggggctgcgggtgcttcaacgtgaaccccagctgcctgttcgtccacacctacctccagtccgtgcgcaaggaggccctgcgggtgttcaactgcatcgactgggtccacaagctgacgctcgagatcaccgacttcgacggcagcgtgtccaccatcgacctgggcgcgagctccagccgcttcaccaactgggggtccgtgagcctgtccctcgacgccgagggcatcagcgggtccaacagcttctccttcatcgagagccccggcaaggggtacgccatcgtcgacgagcccttctccgagatcccgcggcagggcttcctgggcgagatccgctgcaacagcgagtccagcgtgctgtccgcccacgagagctgcctccgggcccccaacctgatcagctacaagcccatgatcgaccagctggagtgcaccacgaacctcatcgaccccttcgtggtcttcgagcgcgggtccctgccgcagacccggaacgacaagaccttcgcggccagcaagggcaaccgcggggtgcaggccttctccaagggcagcgtgcaggccgacctgaccctcatgttcgacaacttcgaggtcgacttcgtgggggccgcggtgtcctgcgacgccgccttcctgaacctgacgggctgctacagctgcaacgccggcgcccgggtctgcctctccatcaccagcaccgggaccggctccctgagcgcgcacaacaaggacgggtccctgcacatcgtgctccccagcgagaacggcacgaaggaccagtgccagatcctgcacttcaccgtgcccgaggtcgaggaggagttcatgtactcctgcgacggggacgagcgccccctgctcgtgaagggcaccctgatcgccatcgacccgttcgacgaccggcgcgaggccggcggggagagcaccgtggtcaaccccaagtccggcagctggaacttcttcgactggttctccgggctgatgagctggttcggcggccccctcaagacgatcctgctgatctgcctctacgtggccctgtccatcgggctgttcttcctcctgatctacctgggccggaccgggctcagcaagatgtggctggcggccaccaagaaggccagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17329 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (opt1)
  source 1..3172: mol_type = other RNA
gggagaaagcttaccatggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgatggccgggatcgccatgaccgtgctgcccgccctggccgtcttcgcgctcgcccccgtggtgttcgccgaggactgcagcgagctgatccaggcctccagccggatcaccacgtgctccaccgagggcgtcaacaccaagtgccgcctgagcgggaccgccctcatccgggcgggcagcgtgggggccgaggcctgcctgatgctgaagggcgtgaaggaggaccagacgaagttcctcaagatcaagaccgtctccagcgagctgtcctgccgcgagggccagagctactggaccgggtccttcagccccaagtgcctgtccagccggcgctgccacctcgtgggcgagtgccacgtgaaccggtgcctgtcctggcgcgacaacgagaccagcgccgagttctccttcgtcggggagagcacgaccatgcgggagaacaagtgcttcgagcagtgcggcggctgggggtgcggctgcttcaacgtgaacccctcctgcctgttcgtgcacacctacctccagagcgtccgcaaggaggccctgcgggtgttcaactgcatcgactgggtgcacaagctgaccctcgagatcacggacttcgacgggtccgtcagcaccatcgacctgggcgcgtccagcagccgcttcaccaactgggggtccgtgagcctgtccctggacgccgagggcatcagcggctccaacagcttctccttcatcgagagcccggggaagggctacgccatcgtggacgagcccttctccgagatcccccggcaggggttcctcggcgagatccgctgcaacagcgagtccagcgtcctgtccgcccacgagagctgcctgcgcgcgccgaacctcatctcctacaagcccatgatcgaccagctggagtgcaccaccaacctgatcgaccccttcgtggtgttcgagcgggggagcctcccccagacgcgcaacgacaagaccttcgccgcctccaagggcaaccggggcgtccaggccttcagcaaggggtccgtgcaggccgacctgaccctgatgttcgacaacttcgaggtggacttcgtcggcgcggccgtgagctgcgacgccgccttcctcaacctgaccgggtgctacagctgcaacgccggcgcgcgcgtgtgcctgtccatcacgagcaccgggaccggctccctcagcgcccacaacaaggacggctccctgcacatcgtcctgccgagcgagaacgggaccaaggaccagtgccagatcctccacttcacggtgcccgaggtggaggaggagttcatgtactcctgcgacggcgacgagcggcccctgctggtcaaggggaccctcatcgccatcgaccccttcgacgaccgccgggaggccggcggggagagcaccgtggtgaacccgaagtccggcagctggaacttcttcgactggttctccggcctgatgagctggttcgggggccccctgaagaccatcctcctgatctgcctgtacgtcgccctctccatcgggctgttcttcctgctcatctacctgggccgcacgggcctgagcaagatgtggctcgcggccaccaagaaggcctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17330 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (opt1)
  source 1..3406: mol_type = other RNA
gggagaaagcttaccatggactggacctggatcctgttcctcgtggccgccgcgacccgcgtccacagcgaggacccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgcagcgagctgatccaggcctccagccggatcacgacctgctccaccgagggcgtgaacaccaagtgccgcctgagcgggaccgccctcatccgggcgggctccgtcggcgccgaggcctgcctgatgctgaagggggtgaaggaggaccagaccaagttcctcaagatcaagaccgtgagctccgagctgagctgccgcgagggccagtcctactggacggggagcttctcccccaagtgcctgagctcccggcgctgccacctggtcggcgagtgccacgtgaaccgctgcctcagctggcgggacaacgagacctccgccgagttcagcttcgtgggcgagagcaccaccatgcgcgagaacaagtgcttcgagcagtgcgggggctgggggtgcggctgcttcaacgtcaacccctcctgcctgttcgtgcacacgtacctgcagagcgtgcggaaggaggccctccgcgtcttcaactgcatcgactgggtgcacaagctgaccctggagatcaccgacttcgacgggtccgtgagcaccatcgacctcggcgcgtccagctcccggttcaccaactggggcagcgtctccctgagcctggacgccgaggggatctccggcagcaactccttcagcttcatcgagtccccggggaagggctacgccatcgtggacgagcccttcagcgagatcccccgccaggggttcctcggcgagatccggtgcaactccgagagctccgtgctgagcgcccacgagagctgcctgcgcgcgcccaacctcatctcctacaagccgatgatcgaccagctggagtgcacgaccaacctgatcgaccccttcgtcgtgttcgagcggggcagcctcccccagacccgcaacgacaagaccttcgccgcctccaaggggaaccggggcgtgcaggccttcagcaaggggtccgtccaggccgacctgacgctgatgttcgacaacttcgaggtggacttcgtgggcgcggccgtcagctgcgacgccgccttcctcaacctgaccgggtgctactcctgcaacgccggcgcgcgcgtgtgcctgagcatcacctccaccggcacggggagcctctccgcccacaacaaggacggcagcctgcacatcgtgctgccctccgagaacgggaccaaggaccagtgccagatcctccacttcaccgtcccggaggtggaggaggagttcatgtacagctgcgacggcgacgagcggcccctgctggtgaaggggaccctcatcgccatcgaccccttcgacgaccgccgggaggccggcggcgagtccacggtcgtgaaccccaagagcgggtcctggaacttcttcgactggttcagcggcctgatgtcctggttcgggggcccgctgaagaccatcctcctgatctgcctgtacgtggccctcagcatcggcctgttcttcctgctcatctacctggggcgcaccggcctgagcaagatgtggctcgcggccaccaagaaggcctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17331 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (opt1)
  source 1..3400: mol_type = other RNA
gggagaaagcttaccatggactggacctggatcctgttcctcgtggccgccgcgacccgcgtccacagcccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgcagcgagctgatccaggcctccagccggatcacgacctgctccaccgagggcgtgaacaccaagtgccgcctgagcgggaccgccctcatccgggcgggctccgtcggcgccgaggcctgcctgatgctgaagggggtgaaggaggaccagaccaagttcctcaagatcaagaccgtgagctccgagctgagctgccgcgagggccagtcctactggacggggagcttctcccccaagtgcctgagctcccggcgctgccacctggtcggcgagtgccacgtgaaccgctgcctcagctggcgggacaacgagacctccgccgagttcagcttcgtgggcgagagcaccaccatgcgcgagaacaagtgcttcgagcagtgcgggggctgggggtgcggctgcttcaacgtcaacccctcctgcctgttcgtgcacacgtacctgcagagcgtgcggaaggaggccctccgcgtcttcaactgcatcgactgggtgcacaagctgaccctggagatcaccgacttcgacgggtccgtgagcaccatcgacctcggcgcgtccagctcccggttcaccaactggggcagcgtctccctgagcctggacgccgaggggatctccggcagcaactccttcagcttcatcgagtccccggggaagggctacgccatcgtggacgagcccttcagcgagatcccccgccaggggttcctcggcgagatccggtgcaactccgagagctccgtgctgagcgcccacgagagctgcctgcgcgcgcccaacctcatctcctacaagccgatgatcgaccagctggagtgcacgaccaacctgatcgaccccttcgtcgtgttcgagcggggcagcctcccccagacccgcaacgacaagaccttcgccgcctccaaggggaaccggggcgtgcaggccttcagcaaggggtccgtccaggccgacctgacgctgatgttcgacaacttcgaggtggacttcgtgggcgcggccgtcagctgcgacgccgccttcctcaacctgaccgggtgctactcctgcaacgccggcgcgcgcgtgtgcctgagcatcacctccaccggcacggggagcctctccgcccacaacaaggacggcagcctgcacatcgtgctgccctccgagaacgggaccaaggaccagtgccagatcctccacttcaccgtcccggaggtggaggaggagttcatgtacagctgcgacggcgacgagcggcccctgctggtgaaggggaccctcatcgccatcgaccccttcgacgaccgccgggaggccggcggcgagtccacggtcgtgaaccccaagagcgggtcctggaacttcttcgactggttcagcggcctgatgtcctggttcgggggcccgctgaagaccatcctcctgatctgcctgtacgtggccctcagcatcggcctgttcttcctgctcatctacctggggcgcaccggcctgagcaagatgtggctcgcggccaccaagaaggcctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17332 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (opt1)
  source 1..1885: mol_type = other RNA
gggagaaagcttaccatggactggacctggatcctgttcctcgtggccgccgcgacccgcgtccacagcgaggacccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17333 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (opt1)
  source 1..1879: mol_type = other RNA
gggagaaagcttaccatggactggacctggatcctgttcctcgtggccgccgcgacccgcgtccacagcccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17334 - RNA, 1795 nt, synthetic construct
  misc_feature 1..1795: note = mRNA product Design1 comprising derived and/or modified sequence from RVFV(ZH-548)__DQ380206.1__IgE-leader_Gc (opt1)
  source 1..1795: mol_type = other RNA
gggagaaagcttaccatggactggacctggatcctgttcctcgtggccgccgcgacccgcgtccacagctgctccgagctgatccaggccagctcccggatcacgacctgcagcaccgagggcgtgaacaccaagtgccgcctgtccgggacggccctcatccgggccggcagcgtgggggccgaggcgtgcctgatgctgaagggcgtcaaggaggaccagaccaagttcctcaagatcaagaccgtgtccagcgagctgtcctgccgcgaggggcagagctactggaccggctccttcagccccaagtgcctgtccagccggcgctgccacctcgtgggcgagtgccacgtcaaccggtgcctgtcctggcgcgacaacgagacgagcgccgagttctccttcgtgggggagagcaccaccatgcgggagaacaagtgcttcgagcagtgcggcgggtggggctgcgggtgcttcaacgtgaacccgtcctgcctgttcgtccacacctacctccagagcgtgcgcaaggaggccctgcgggtgttcaactgcatcgactgggtccacaagctgacgctcgagatcaccgacttcgacggcagcgtgtccaccatcgacctgggcgccagctccagccgcttcaccaactgggggtccgtgagcctgtccctcgacgcggagggcatcagcgggtccaacagcttctccttcatcgagagccccggcaagggctacgccatcgtcgacgagcccttctccgagatcccccggcaggggttcctgggcgagatccgctgcaacagcgagtccagcgtgctgtccgcccacgagagctgcctccgggccccgaacctgatctcctacaagcccatgatcgaccagctggagtgcacgaccaacctcatcgaccccttcgtggtcttcgagcgcgggagcctgccccagacccggaacgacaagaccttcgccgcgagcaagggcaaccgcggggtgcaggccttctccaagggcagcgtgcaggccgacctgacgctcatgttcgacaacttcgaggtcgacttcgtgggcgccgccgtgtcctgcgacgcggccttcctgaacctgaccgggtgctacagctgcaacgccggcgcccgggtctgcctctccatcaccagcaccgggacgggctccctgagcgcccacaacaaggacgggtccctgcacatcgtgctcccgagcgagaacggcaccaaggaccagtgccagatcctgcacttcaccgtccccgaggtggaggaggagttcatgtactcctgcgacggcgacgagcgccccctgctcgtgaaggggaccctgatcgcgatcgaccccttcgacgaccggcgcgaggccggcggggagagcacggtcgtgaacccgaagtccggcagctggaacttcttcgactggttctccgggctgatgagctggttcggcggccccctcaagaccatcctgctgatctgcctctacgtggccctgtccatcgggctgttcttcctcctgatctacctgggccgcaccgggctcagcaagatgtggctggccgccaccaagaaggcgagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17335 - RNA, 955 nt, synthetic construct
  misc_feature 1..955: note = mRNA product Design1 comprising derived and/or modified sequence from RVFV(ZH-548)__DQ380151.1__N (opt5)
  source 1..955: mol_type = other RNA
gggagaaagcttaccatggacaactaccaagagctggccatccaattcgctgcccaggcggtggatagaaatgaaattgagcagtgggtccgggaatttgcttatcagggcttcgacgcccgcagagttatcgagctcctgaagcaatacgggggagccgattgggaaaaagacgctaagaaaatgattgtgcttgccctgacccggggcaacaagccccgcagaatgatgatgaaaatgagcaaggaggggaaggctacagtggaggccctcatcaataaatataagctgaaagaaggaaacccttcccgggatgagcttacgctgtctcgcgtcgcggccgctctcgccggctggacctgccaggctctggtggttctgagcgaatggctcccggtgacagggaccacaatggacggactgtcccccgcctaccctagacacatgatgcatccctcttttgcgggcatggtcgatcctagccttcccggcgactatctgcgggccattctcgatgctcactccctgtaccttctgcagttctctcgcgtgatcaatcctaacctcagagggcggaccaaggaggaggttgccgctacatttacccagccgatgaatgccgccgtgaacagcaatttcatctcccatgaaaaacgcagagagtttctgaaggctttcggactggtcgacagcaacggcaagccctctgcggccgtgatggctgccgcccaggcttataaaacggccgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17336 - RNA, 3811 nt, synthetic construct
  misc_feature 1..3811: note = mRNA product Design1 comprising derived and/or modified sequence from RVFV(ZH-548)__DQ380206.1__GP (opt5)
  source 1..3811: mol_type = other RNA
gggagaaagcttaccatgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctcctgtccgctcacgggaatccttgcatgaaggagaagctggtgatgaaaacccattgtcccaacgattatcagagcgcccactacctcaataacgacggaaagatggcctctgtcaaatgcccgcctaagtatgaactgacagaggactgtaatttctgccgccaaatgaccggcgcttcccttaaaaaggggagctaccccctgcaggatctcttttgccagtcctctgaagacgatggaagcaaactgaagacgaagatgaaaggcgtttgtgaggtgggcgtgcaggcgcttaagaaatgcgacgggcaactgtccacagcccatgaagtcgtgcctttcgctgtttttaagaacagcaaaaaggtgtacctcgataagctggacctgaaaaccgaggagaatctcctgcccgattctttcgtctgttttgaacacaagggacagtataaaggcacaatggactccgggcagaccaagagagagcttaaatctttcgatatttctcagtgccccaagatcggaggccacgggagcaagaaatgtaccggagacgccgccttttgctccgcttacgaatgtacagcccaatatgcgaacgcttactgctctcatgccaatggcagcggcattgtgcagatccaggtttccggggtgtggaagaaacctctgtgtgtcggatatgagcgggtggtcgtgaagcgcgaactcagcgccaaaccgattcaaagagttgagccctgcacgacctgtatcacaaagtgcgagcctcacggcctggtggtccggtctaccgggttcaagatctccagcgctgtggcctgcgcttctggagtttgtgtgacaggctcccagagcccctccaccgaaattacgcttaaataccctgggatctctcagagctccggcggagatattggcgtccatatggcccacgacgaccagtctgtgagctccaagatcgtggcgcattgtcccccgcaagatccttgcctggttcacgactgcattgtctgtgcccacgggctcatcaactatcagtgccatacagctctgagcgccttcgtggtggtctttgtgttctcttccatcgctattatctgtctggccattctctacagagttctgaaatgccttaagatcgcgccccgcaaagtgctgaatcctctcatgtggattaccgcctttatccggtggatttacaagaaaatggtcgctagagtggccgataacatcaaccaggttaatcgcgagatcggatggatggaaggcgggcagctggtgctgggaaaccccgctcctattccccggcacgccccgatccctagatatagcacctaccttatgctcctgctgattgtctcttatgcctccgcttgtagcgagctcatccaagcgtctagccgcattacaacctgctccacagagggcgtgaatacgaagtgtcggctgagcgggaccgcccttatcagagctggctctgttggagccgaagcctgcctgatgctcaagggcgtgaaagaggaccagacaaagttcctgaaaatcaagaccgtctccagcgaactgtcctgccgcgaggggcagtcttactggacaggcagcttttcccccaaatgtctttctagccggagatgccatctcgtgggagaatgtcacgtgaaccgctgcctgtcctggcgggataatgagacctctgctgagttcagctttgtcggggaatccacgaccatgagagagaacaagtgtttcgaacagtgcggaggctgggggtgtggctgctttaatgttaaccccagctgtctgttcgtgcacacatatctccaatctgtgcggaaggaggccctgcgcgtctttaattgcattgactgggtgcataaacttaccctggaaatcacagatttcgacggatccgttagcaccattgatctcggcgcgtcttccagcagatttacgaactgggggtctgtgtccctgagcctggacgctgagggaatctccggcagcaattctttcagcttcattgagtcccctgggaagggatacgccatcgtcgatgaaccgttttctgagatcccccggcagggcttccttggggaaattagatgtaacagcgagtcctctgtgctcagcgcccacgaatcctgcctgcgcgctcctaatctgatctcttataaacccatgattgaccagctcgagtgcacaaccaacctgatcgatccttttgttgtgttcgagcggggcagccttccccagacaagaaatgacaagacctttgccgcgtccaaaggaaaccgcggcgtccaggctttcagcaaggggtctgtgcaagccgacctgaccctcatgtttgataacttcgaagttgactttgtgggagccgctgtctcctgtgatgccgctttcctgaatctgacaggctgctacagctgtaacgccggggcgagagtgtgcctttctattacgtccaccggaacaggcagcctctccgcccataataaggacggctctctgcacatcgtgctgcctagcgagaacgggaccaaagatcagtgtcaaatcctccattttacagtccccgaagttgaggaggagttcatgtactcctgcgacggagatgagcggccgctgcttgtgaagggcaccctgattgctatcgacccttttgatgaccgcagagaagccgggggagagagcacggtggtcaatcccaaatctggctcctggaacttcttcgattggtttagcgggctcatgtcttggttcggaggccctctgaagacaattctgcttatctgtctgtatgtggctctcagcattggcctgtttttcctcctgatctaccttgggcggaccggactgtccaaaatgtggctcgccgccaccaagaaggcttcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17337 - RNA, 3421 nt, synthetic construct
  misc_feature 1..3421: note = mRNA product Design1 comprising derived and/or modified sequence from RVFV(ZH-548)__DQ380206.1__Gn-Gc (opt5)
  source 1..3421: mol_type = other RNA
gggagaaagcttaccatggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccctgtccgctttcgtggttgtgttcgtctttagctctattgccatcatttgcctggctatcctctacagagtgctgaagtgtcttaaaattgcgccccggaaggtgctgaaccctctcatgtggatcaccgccttcatccgctggatttataaaaagatggttgccagagtcgctgacaatatcaaccaagtgaatcgggaaattgggtggatggagggaggccagctggtgcttgggaaccccgccccgatccctcgccacgctcccattcctagatactccacatacctgatgctcctgctgatcgtcagctatgcctccgcgtgctctgaactcatccaggccagctcccggattaccacatgttctaccgagggcgtgaacacgaagtgccgcctgagcggaacagctcttatcagagccggctccgttggggctgaagcctgtctgatgctcaaaggagtgaaggaggatcagaccaaatttctgaagattaaaaccgtcagctctgagctgtcctgccgggaaggccaaagctactggacagggtctttctcccccaagtgtcttagctctagacgctgccatctcgtgggagagtgtcacgttaatcggtgcctgagctggagagacaacgaaacctccgccgagtttagcttcgtgggcgaatctacaacgatgcgcgagaataaatgctttgagcagtgtgggggctggggatgcggctgtttcaacgtcaatccttcctgcctgtttgtgcatacctatctccagagcgttcggaaggaagctctgagagtgttcaactgtatcgactgggtccacaaacttacactggagattaccgattttgacgggtccgtgtctacaatcgatctcggagcgagctcctctcgcttcaccaattggggcagcgtgtccctgtctctggacgccgaagggattagcggatccaacagcttttctttcatcgagtcccccggcaaagggtacgctatcgtcgatgagccgttcagcgaaattcctcggcagggctttcttggagagatcagatgcaattctgaatccagcgttctctctgcccacgagtcctgtctgcgcgcccccaacctgattagctataagcccatgatcgaccaactcgaatgcacgaccaatctgattgatcctttcgtggtgtttgagcggggctcccttccgcagacaagaaacgacaaaaccttcgctgccagcaaggggaatcgcggagtccaggcgttttctaaaggcagcgtgcaggctgatctgacactcatgttcgacaactttgaggttgatttcgtgggggccgccgtctcctgtgacgctgcctttctgaatctgaccggatgctactcttgtaacgcgggcgctcgggtgtgccttagcatcacgtccacagggaccggctctctcagcgcccataacaaggatggatccctgcacatcgttctgccctctgaaaatggcacaaaggaccaatgccagattctccatttcaccgtgcctgaggtcgaagaggaatttatgtatagctgtgacggggatgagagacccctgcttgtgaaaggaaccctgatcgccattgaccctttcgatgaccggcgcgaggctggcggggaatccacagttgtgaaccccaagagcggatcttggaactttttcgattggttctccggcctcatgagctggtttggcgggcctctgaaaacgatcctgcttatttgcctctacgtcgccctgtctatcggactgttctttctcctgatctaccttggcagaaccgggctgtccaagatgtggctcgctgccacaaagaaggcgagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17338 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (opt5)
  source 1..3172: mol_type = other RNA
gggagaaagcttaccatggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccatggctgggattgccatgaccgtgctgcccgctctggccgttttcgcgctcgcccctgtggtcttcgctgaagactgctccgagctgatccaagccagctctagaattacaacctgttccacagaaggagtgaacaccaagtgccggcttagcggcacggctctgatccgcgccgggtccgtgggcgcggaggcctgtctcatgctgaaaggagttaaggaagatcagacaaaatttcttaagattaagaccgtctctagcgagctgtcctgcagagagggccagtcttactggaccgggagcttctcccccaaatgtctcagctctcggcgctgccacctggtgggagaatgtcatgtgaatagatgcctgtcctggcgggacaacgagacaagcgctgaattttctttcgtcggcgagtccaccacaatgcgcgaaaataagtgttttgagcagtgcgggggatggggctgcgggtgtttcaacgtgaacccgagctgcctctttgttcacacgtatctgcaatctgtgagaaaagaggcccttcgggtcttcaattgtatcgactgggtgcataagctgaccctcgaaatcacagattttgacggcagcgtttccaccattgatctgggagcttctagctccagattcacaaactggggcagcgtgtccctgtctcttgacgccgaggggatcagcggatccaattcttttagcttcattgaatcccctggcaaagggtacgccatcgtcgatgagcccttttctgagattcctcgccagggattcctcggcgaaatccggtgcaacagcgagtccagcgtgctgtctgctcacgaatcctgtctgagagcgcccaatctcatcagctacaagcctatgattgaccagctggagtgcaccacgaaccttatcgatcccttcgttgtgtttgaacgcgggtctctgccgcagacccggaatgacaaaacattcgccgcttccaagggcaacagaggagtccaagcctttagcaagggctctgtgcaggccgatctcaccctgatgttcgacaattttgaggtggatttcgtcggggctgccgtttcctgtgacgcggcttttctgaaccttacaggatgctatagctgtaatgccggcgcccgcgtgtgcctctccattaccagcacggggacaggatctctgagcgctcacaacaaagatggctccctgcatatcgtgctcccttctgagaatgggaccaaggaccagtgtcagattctgcacttcacagtccccgaagtggaggaagagtttatgtacagctgcgacggcgatgaacggccccttctggttaaaggaaccctcatcgccattgaccctttcgatgacagacgcgaggcgggcggggagtccaccgtggtcaacccgaagtctggaagctggaactttttcgattggttttccggcctgatgtcttggttcgggggacccctgaaaacaatccttctcatctgcctgtatgtggctctgagcattggcctcttctttctgcttatctacctgggccggacggggctctccaagatgtggctggccgccaccaagaaagctagctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17339 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (opt5)
  source 1..3406: mol_type = other RNA
gggagaaagcttaccatggactggacctggatcctgttcctcgtggccgctgccacaagagtccacagcgaggatccccatctgcggaaccgccctggcaaggggcacaattacattgacggaatgacgcaggaagatgcgacctgcaaaccggttacatatgctggcgcctgttcctcttttgacgtgcttctggagaaggggaaattccccctctttcaaagctacgcccatcacagaaccctgcttgaagctgtgcatgatacaatcattgccaaggctgaccctccctcctgcgatctgctctctgcccacggaaacccttgtatgaaagagaagctggtcatgaagacccactgccccaatgactatcagagcgcgcattacctgaacaatgatggcaaaatggcctccgtgaagtgtcctccgaaatatgaactcacagaggactgcaacttctgtcggcagatgaccggggcttctctgaagaaaggaagctacccccttcaggatctgttttgccaatccagcgaggacgatggctctaagctcaagacgaaaatgaagggcgtttgtgaagtgggggtccaggccctgaaaaagtgcgacggacagctttccaccgctcacgaggtggttcctttcgccgtgtttaaaaatagcaagaaagtctatctggacaagctcgatctgaagacagaagagaacctgctccccgactctttcgtgtgttttgagcataaaggccagtacaaggggaccatggattccggacaaacaaaacgcgaacttaagagcttcgacatctctcagtgccctaaaattggcgggcacggatccaagaagtgcaccggcgatgcggccttttgtagcgcttacgagtgcacggcccagtatgctaatgcctactgttcccacgccaacggctctgggatcgtgcagatccaagtcagcggagtttggaaaaagcccctgtgcgtgggctatgaaagagtggtcgtgaaacgggagctgtccgctaagccgattcagcgcgttgaaccttgtacaacctgcatcacaaaatgtgagccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgacatcggggtccacatggcccatgatgaccagagcgtgtcttccaaaattgtcgcccactgtccccctcaggatccgtgccttgtgcatgactgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgataatatcaaccaagttaatcgcgaaattggctggatggaagggggacagctcgtcctgggcaaccccgcccctatccccagacatgcgccgattcctcggtacagcacctaccttatgctgctcctgatcgtgtcctatgcctctgcttgcagcgaactgatccaggcctcctctcgcattacaacctgtagcacggagggggtgaacacaaagtgcagactctccggcaccgctctgatccgggccggaagcgtcggcgcggaagcctgtcttatgctgaaaggggtgaaggaggaccagaccaaattcctcaagattaaaacagtttcttccgagctgagctgcagagaaggacaatcttactggaccggctcctttagccccaagtgtctgtctagccgccggtgccaccttgtgggggagtgtcatgtcaatagatgcctctcctggcgcgacaacgaaacaagcgctgagttctcttttgtgggagaatccacgaccatgcgggagaataaatgcttcgagcagtgtggcgggtggggctgcggatgttttaacgttaatcctagctgcctgttcgtgcacacatatctgcagtccgtcagaaaggaagccctccgcgtgtttaactgtatcgattgggttcacaagctgacccttgagattacagacttcgatggctctgtgagcaccatcgacctgggggcttcctctagccggtttacgaattggggatccgtctctctcagcctggatgccgaaggcatttccgggagcaactctttctcctttatcgagagccccggaaaaggctacgccatcgtggacgagcctttctctgaaattcccagacaggggttcctgggcgagatccgctgcaattccgaaagctctgtgctttccgctcatgagagctgtctccgggcgccgaacctgatttcctataagcctatgatcgatcaactggaatgcaccacaaatctcattgacccctttgtcgttttcgagagaggaagcctgccccagacccgcaacgataaaacatttgccgcttctaagggcaatagaggggtgcaggccttcagcaaaggatccgtgcaggccgaccttaccctgatgtttgataacttcgaggtcgactttgtgggcgctgccgtttcttgtgatgcggctttcctcaatctgacggggtgctacagctgtaacgccggagcccgggtgtgcctgtccatcacatctaccggcacagggagcctttccgctcacaacaaggacggctctctccatatcgtcctgcctagcgaaaatggaaccaaggaccaatgccagattctgcactttaccgtgccggaggttgaagaggagttcatgtattcctgtgatggcgacgagcggcccctcctggtgaaagggacacttatcgccattgatccttttgacgatcgcagagaggcgggaggcgaaagcacggtcgtgaaccccaagtctgggtcctggaatttctttgactggttcagcggactgatgtcttggttcggcggccctctcaaaaccatcctgctgatttgcctttacgttgctctctccatcgggctgtttttcctgctcatctacctgggacggacaggccttagcaagatgtggctggccgccaccaaaaaggcttcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17340 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (opt5)
  source 1..3400: mol_type = other RNA
gggagaaagcttaccatggactggacctggatcctgttcctcgtggccgctgccacaagagtccacagcccccatctgcggaaccgccctggcaaggggcacaattacattgatggaatgacgcaggaggacgcgacctgcaaaccggttacatatgctggcgcctgttcctcttttgatgtgcttctggaaaaggggaaattccccctctttcaaagctacgcccatcacagaaccctgcttgaggctgtgcatgacacaatcattgccaaggctgatcctccctcctgcgacctgctctctgcccacggaaacccttgtatgaaagaaaagctggtcatgaagacccactgccccaatgattatcagagcgcgcattacctgaacaatgacggcaaaatggcctccgtgaagtgtcctccgaaatatgagctcacagaagattgcaacttctgtcggcagatgaccggggcttctctgaagaaaggaagctacccccttcaggacctgttttgccaatccagcgaggatgacggctctaagctcaagacgaaaatgaagggcgtttgtgaggtgggggtccaggccctgaaaaagtgcgatggacagctttccaccgctcacgaagtggttcctttcgccgtgtttaaaaatagcaagaaagtctatctggacaagctcgacctgaagacagaggaaaacctgctccccgattctttcgtgtgttttgagcataaaggccagtacaaggggaccatggactccggacaaacaaaacgcgagcttaagagcttcgatatctctcagtgccctaaaattggcgggcacggatccaagaagtgcaccggcgacgcggccttttgtagcgcttacgaatgcacggcccagtatgctaatgcctactgttcccacgccaacggctctgggatcgtgcagatccaagtcagcggagtttggaaaaagcccctgtgcgtgggctatgagagagtggtcgtgaaacgggaactgtccgctaagccgattcagcgcgttgagccttgtacaacctgcatcacaaaatgtgaaccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgatatcggggtccacatggcccatgacgatcagagcgtgtcttccaaaattgtcgcccactgtccccctcaggacccgtgccttgtgcatgattgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgacaatatcaaccaagttaatcgcgagattggctggatggaagggggacagctcgtcctgggcaaccccgcccctatccccagacatgcgccgattcctcggtacagcacctaccttatgctgctcctgatcgtgtcctatgcctctgcttgcagcgagctgatccaggcctcctctcgcattacaacctgtagcacggaaggggtgaacacaaagtgcagactctccggcaccgctctgatccgggccggaagcgtcggcgcggaggcctgtcttatgctgaaaggggtgaaggaagatcagaccaaattcctcaagattaaaacagtttcttccgagctgagctgcagagagggacaatcttactggaccggctcctttagccccaagtgtctgtctagccgccggtgccaccttgtgggggaatgtcatgtcaatagatgcctctcctggcgcgacaacgagacaagcgctgagttctcttttgtgggagaatccacgaccatgcgggaaaataaatgcttcgagcagtgtggcgggtggggctgcggatgttttaacgttaatcctagctgcctgttcgtgcacacatatctgcagtccgtcagaaaggaggccctccgcgtgtttaactgtatcgactgggttcacaagctgacccttgaaattacagatttcgacggctctgtgagcaccatcgatctgggggcttcctctagccggtttacgaattggggatccgtctctctcagcctggacgccgagggcatttccgggagcaactctttctcctttatcgaaagccccggaaaaggctacgccatcgtggatgagcctttctctgagattcccagacaggggttcctgggcgaaatccgctgcaattccgagagctctgtgctttccgctcatgaaagctgtctccgggcgccgaacctgatttcctataagcctatgatcgaccaactggagtgcaccacaaatctcattgatccctttgtcgttttcgaaagaggaagcctgccccagacccgcaacgacaaaacatttgccgcttctaagggcaatagaggggtgcaggccttcagcaaaggatccgtgcaggccgatcttaccctgatgtttgacaacttcgaggtcgattttgtgggcgctgccgtttcttgtgacgcggctttcctcaatctgacggggtgctacagctgtaacgccggagcccgggtgtgcctgtccatcacatctaccggcacagggagcctttccgctcacaacaaggatggctctctccatatcgtcctgcctagcgagaatggaaccaaggaccaatgccagattctgcactttaccgtgccggaagttgaggaagagttcatgtattcctgtgacggcgatgaacggcccctcctggtgaaagggacacttatcgccattgacccttttgatgaccgcagagaggcgggaggcgagagcacggtcgtgaaccccaagtctgggtcctggaatttctttgattggttcagcggactgatgtcttggttcggcggccctctcaaaaccatcctgctgatttgcctttacgttgctctctccatcgggctgtttttcctgctcatctacctgggacggacaggccttagcaagatgtggctggccgccaccaaaaaggcttcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17341 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (opt5)
  source 1..1885: mol_type = other RNA
gggagaaagcttaccatggactggacctggatcctgttcctcgtggccgctgccacaagagtccacagcgaggatccccatctgcggaaccgccctggcaaggggcacaattacattgacggaatgacgcaggaggatgcgacctgcaaaccggttacatatgctggcgcctgttcctcttttgacgtgcttctggagaaggggaaattccccctctttcaaagctacgcccatcacagaaccctgcttgaagctgtgcatgatacaatcattgccaaggctgaccctccctcctgcgatctgctctctgcccacggaaacccttgtatgaaagagaagctggtcatgaagacccactgccccaatgactatcagagcgcgcattacctgaacaatgatggcaaaatggcctccgtgaagtgtcctccgaaatatgaactcacagaggactgcaacttctgtcggcagatgaccggggcttctctgaagaaaggaagctacccccttcaggatctgttttgccaatccagcgaggacgatggctctaagctcaagacgaaaatgaagggcgtttgtgaagtgggggtccaggccctgaaaaagtgcgacggacagctttccaccgctcacgaggtggttcctttcgccgtgtttaaaaatagcaagaaagtctatctggacaagctcgatctgaagacagaagagaacctgctccccgactctttcgtgtgttttgagcataaaggccagtacaaggggaccatggattccggacaaacaaaacgcgaacttaagagcttcgacatctctcagtgccctaaaattggcgggcacggatccaagaagtgcaccggcgatgcggccttttgtagcgcttacgagtgcacggcccagtatgctaatgcctactgttcccacgccaacggctctgggatcgtgcagatccaagtcagcggagtttggaaaaagcccctgtgcgtgggctatgaaagagtggtcgtgaaacgggagctgtccgctaagccgattcagcgcgttgaaccttgtacaacctgcatcacaaaatgtgagccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgacatcggggtccacatggcccatgatgaccagagcgtgtcttccaaaattgtcgcccactgtccccctcaggatccgtgccttgtgcatgactgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgataatatcaaccaagttaatcgcgaaattggctggatggaagggggacagctcgtcctgggcaaccccgcccctatccccagacatgcgccgattcctcggtacagcacctaccttatgctgctcctgatcgtgtcctatgcctctgcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17342 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (opt5)
  source 1..1879: mol_type = other RNA
gggagaaagcttaccatggactggacctggatcctgttcctcgtggccgctgccacaagagtccacagcccccatctgcggaaccgccctggcaaggggcacaattacattgatggaatgacgcaggaggacgcgacctgcaaaccggttacatatgctggcgcctgttcctcttttgatgtgcttctggaaaaggggaaattccccctctttcaaagctacgcccatcacagaaccctgcttgaggctgtgcatgacacaatcattgccaaggctgatcctccctcctgcgacctgctctctgcccacggaaacccttgtatgaaagaaaagctggtcatgaagacccactgccccaatgattatcagagcgcgcattacctgaacaatgacggcaaaatggcctccgtgaagtgtcctccgaaatatgagctcacagaagattgcaacttctgtcggcagatgaccggggcttctctgaagaaaggaagctacccccttcaggacctgttttgccaatccagcgaggatgacggctctaagctcaagacgaaaatgaagggcgtttgtgaggtgggggtccaggccctgaaaaagtgcgatggacagctttccaccgctcacgaagtggttcctttcgccgtgtttaaaaatagcaagaaagtctatctggacaagctcgacctgaagacagaggaaaacctgctccccgattctttcgtgtgttttgagcataaaggccagtacaaggggaccatggactccggacaaacaaaacgcgagcttaagagcttcgatatctctcagtgccctaaaattggcgggcacggatccaagaagtgcaccggcgacgcggccttttgtagcgcttacgaatgcacggcccagtatgctaatgcctactgttcccacgccaacggctctgggatcgtgcagatccaagtcagcggagtttggaaaaagcccctgtgcgtgggctatgagagagtggtcgtgaaacgggaactgtccgctaagccgattcagcgcgttgagccttgtacaacctgcatcacaaaatgtgaaccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgatatcggggtccacatggcccatgacgatcagagcgtgtcttccaaaattgtcgcccactgtccccctcaggacccgtgccttgtgcatgattgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgacaatatcaaccaagttaatcgcgagattggctggatggaagggggacagctcgtcctgggcaaccccgcccctatccccagacatgcgccgattcctcggtacagcacctaccttatgctgctcctgatcgtgtcctatgcctctgcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17343 - RNA, 1795 nt, synthetic construct
  misc_feature 1..1795: note = mRNA product Design1 comprising derived and/or modified sequence from RVFV(ZH-548)__DQ380206.1__IgE-leader_Gc (opt5)
  source 1..1795: mol_type = other RNA
gggagaaagcttaccatggactggacatggatcctgttcctcgtggccgctgccacaagagtccacagctgctccgagctgattcaggcgtctagccggatcacgacctgttccacagaaggcgttaataccaagtgccgcctttctgggacagctctgattagagccggaagcgtgggcgccgaggcttgtctcatgctgaaaggggtgaaggaagatcaaaccaaatttcttaagatcaaaacagtctcctctgagctgagctgccgggaaggacagtcctactggaccggcagcttctctcccaagtgtctctccagccgcagatgccatctggtgggggagtgtcacgttaatcggtgcctgtcttggcgcgacaacgagacgtccgccgaatttagcttcgtgggagagtctaccacaatgagagaaaataagtgttttgagcagtgcggcggctgggggtgtggatgcttcaacgtcaatccttcctgcctctttgtgcatacctatctgcagagcgttcggaaagaggctctccgcgtgttcaactgtattgattgggtccacaagctgacactcgaaatcaccgactttgatggctccgtgtctacgatcgacctgggggccagctccagcagattcacaaattggggatctgtgtcccttagcctggatgcggagggcatttctgggagcaactccttttctttcatcgaaagcccgggaaaaggctacgccattgtcgacgagcccttttccgaaatccctcggcaaggcttcctcggggagattcgctgcaatagcgagtcttccgttctgagcgctcatgaatcttgtctgagagcccccaacctcatctcctataagcctatgattgatcagctggagtgcaccacaaatcttatcgaccccttcgtggtgtttgaacggggaagcctgcctcagacccgcaacgataaaaccttcgctgcctccaagggcaatagaggggtccaggcgttttctaagggaagcgtgcaagccgacctcacactgatgttcgataactttgaggttgacttcgtgggcgctgccgtctcctgtgacgctgcctttcttaatctgacggggtgctactcttgtaacgccggagctcgggtgtgcctcagcatcacctccacaggcaccggcagcctgtctgcgcacaacaaagatgggtccctgcacattgttctcccgagcgaaaatggaacaaaggaccagtgtcagatcctgcatttcaccgtgcccgaggtcgaggaagagtttatgtattcttgcgatggcgacgaaagacctcttctggtgaaagggacgctcattgccatcgatcccttcgacgatcgccgggaggctggaggcgaatccacagtcgtgaaccctaagagcgggtcttggaactttttcgactggtttagcggcctgatgtcctggttcggaggcccccttaaaaccattctgctcatctgtctgtacgttgccctgagcatcgggcttttctttctgcttatttatctgggaagaaccggcctctctaagatgtggctggccgctaccaaaaaggcctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17344 - RNA, 955 nt, synthetic construct
  misc_feature 1..955: note = mRNA product Design1 comprising derived and/or modified sequence from RVFV(ZH-548)__DQ380151.1__N (opt11)
  source 1..955: mol_type = other RNA
gggagaaagcttaccatggacaactaccaagaactcgcaatccagttcgccgcccaagccgtcgaccgcaacgaaatcgaacaatgggtccgagaatttgcctaccaaggcttcgacgcccgacgagtcatcgaactcctcaaacaatacggaggcgccgactgggaaaaagacgccaagaaaatgatcgtactagccctcacccgaggcaacaaaccccgccgaatgatgatgaaaatgtcaaaagaaggcaaagccaccgtcgaagccctcatcaacaaatacaaactcaaggaaggcaacccctcccgggacgaactcacactctcccgcgtagccgcagccctcgccggctggacctgccaagccctcgtcgtcctatccgaatggcttccagtcacaggcacaaccatggacggcctctcccccgcctatccccgccacatgatgcacccctcattcgccggcatggtcgacccctcactccccggcgactacctacgagccatcctagacgcacactccctctacctcctccaattctcccgcgtcatcaaccccaacctacgcggccgcaccaaagaagaagtagccgccaccttcacacaaccaatgaacgccgcagtcaactccaacttcatctcccacgaaaaacgccgcgaatttctcaaagccttcggccttgtagactccaacggcaaaccctccgccgccgtcatggctgccgcacaagcgtacaaaaccgccgcataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17345 - RNA, 3811 nt, synthetic construct
  misc_feature 1..3811: note = mRNA product Design1 comprising derived and/or modified sequence from RVFV(ZH-548)__DQ380206.1__GP (opt11)
  source 1..3811: mol_type = other RNA
gggagaaagcttaccatgtacgttctgctcaccatactcatctccgtcctcgtctgtgaagcagttattcgggtctcactatcgagcactcgggaagagacatgcttcggagactccaccaatccagaaatgatagagggtgcctgggactcattacgagaggaagaaatgccagaggaactctcgtgctcaatatcgggcattcgggaggtcaaaacgtccagtcaagagctatatcgcgcactgaaagcaatcattgcagccgacggactcaataacatcacgtgccatggaaaagacccagaggacaaaatatcactaatcaagggcccaccacacaagaaacgagtcggcatagtccgatgcgaacgtcgccgcgacgccaaacaaatcggtcgagaaaccatggccggaatcgcaatgaccgtactacccgccctcgcggttttcgccctagcacccgtcgtcttcgcggaagacccccacctccgcaaccggccaggcaaaggtcacaactatatagacggaatgacgcaggaagacgcaacatgtaaaccagtaacctatgccggcgcatgcagctcatttgacgtcctcctcgagaaaggcaagttcccgctattccaaagctacgctcaccaccgcaccctcctggaggccgtacacgacacaataatcgcgaaagcggacccacccagttgcgatctactatcggcccacggaaatccctgtatgaaagaaaagctagttatgaaaacccattgccccaacgactaccagagcgcccactacctcaacaatgatgggaaaatggcctcagtcaaatgcccgcccaaatacgaactaaccgaggactgcaacttctgccgccaaatgaccggagcctcactaaagaaaggctcttaccccctccaagacctcttttgccaatcgtccgaggacgatggctcaaaacttaaaacaaaaatgaaaggtgtctgcgaagtcggagtgcaagccctgaagaaatgtgacggacaactctccacagcccacgaagtagtacccttcgccgtattcaaaaactcaaagaaagtatacctggacaaactggaccttaaaacagaggaaaacctgctgcccgactcctttgtgtgcttcgaacacaaaggccaatacaaaggcactatggacagcggacagaccaaacgggaactaaagagcttcgacatctcccaatgtcccaaaattggcggccacggatccaagaaatgtacaggggacgccgccttctgctcagcctacgaatgcaccgcgcaatacgctaacgcgtactgctcccatgccaacgggtccggcatcgtccagatccaagtctccggcgtgtggaagaaacctctctgtgtaggctatgaacgcgtcgtagtcaaaagagaactctctgctaaacccatccaacgggtggaaccatgcaccacgtgcataacaaaatgcgagccacacggcctcgttgttcgatccacaggctttaaaatctcaagcgctgtagcctgcgcatccggcgtctgcgtcaccggttctcagtccccatcaacagagatcacactgaaataccccggcatatcccaatcatcgggcggcgacataggagttcacatggctcacgacgaccagagcgtatcctccaaaatcgtcgcccactgcccaccccaggacccctgcctcgttcatgactgcatcgtctgtgcacacggcctcataaactaccaatgccacaccgccctatccgcctttgtcgtggtattcgtattcagcagcatcgcaatcatatgccttgcaatcctgtaccgcgtcctgaaatgccttaaaattgccccacgcaaagtcctcaacccactgatgtggatcactgccttcatacgctggatatacaagaaaatggtcgcccgcgtagccgacaacatcaaccaagtaaaccgagagataggctggatggagggcggccaactcgtccttggcaacccagccccaatacccaggcacgcaccgattcctcggtattccacatacctcatgctccttctgatcgtcagctacgcatcggcctgctccgaactcatacaggcatccagcagaattacaacctgttcaaccgagggcgtcaacacgaaatgtcgtctgtccggtaccgcactaatacgcgctggttcagtaggagcggaggcctgtcttatgcttaaaggcgtaaaagaggatcaaaccaaattcctgaaaatcaaaacagtgagctcggaactctcatgccgcgaaggacaatcctactggacaggatcgttctcaccaaaatgcctatctagcagacgatgccacctcgtcggggagtgccatgtgaatcgctgcctctcctggcgagacaacgagacaagcgccgagttctctttcgtaggggaaagcaccaccatgagagaaaacaaatgcttcgaacagtgcggcggatggggatgcggctgctttaacgtcaacccctcgtgcctgtttgtacatacttacctccaatcagtacgcaaagaagcattgcgcgttttcaattgcatcgactgggtccacaaactcaccctagaaatcacagacttcgacggctccgtctcgaccatcgacctgggcgccagctcctcaaggttcacgaactggggctccgtatccctctcccttgacgcggaaggaatctccggcagcaactcgttctcattcatcgaatcacccggaaaaggctacgccatcgtcgacgaacccttctccgaaataccgagacaaggattcctcggagaaatcagatgcaactcagagagctccgtgctgtctgcccacgaaagttgcctcagagcacccaacctcatcagctacaaaccaatgatcgatcaactagaatgcactactaacctaatagacccctttgtcgttttcgaacgcggctccctcccacaaaccaggaacgacaaaacctttgcagctagtaaaggaaacagaggagtccaagcgttctcaaaaggctcagtccaagcagatctaaccctcatgttcgacaacttcgaggttgacttcgtgggcgccgcagtctcctgtgacgcagcgttcttgaacctcacaggctgctactcttgcaacgccggagcaagagtttgcctctcaatcacgagcacaggaacgggatccctatcagcccacaacaaagacggcagccttcacatcgtactcccgtctgagaacggaaccaaagatcaatgtcaaatcctacacttcaccgtacccgaagtcgaagaagagttcatgtactcttgcgacggcgacgaacgaccactactcgtcaaagggaccctcatcgcaattgacccattcgatgatcgccgcgaagctggaggcgagagcacagtcgtcaaccccaaaagcggctcctggaactttttcgactggttcagcggactcatgtcctggtttggtggcccactcaaaacaatcctcctcatctgcctctacgtagccctgagcatcggcctcttcttcctccttatctacctagggcgaacagggctttcgaaaatgtggcttgctgccaccaagaaagcctcctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17346 - RNA, 3421 nt, synthetic construct
  misc_feature 1..3421: note = mRNA product Design1 comprising derived and/or modified sequence from RVFV(ZH-548)__DQ380206.1__Gn-Gc (opt11)
  source 1..3421: mol_type = other RNA
gggagaaagcttaccatggcaggaatagcaatgacggttctgccagcgctagccgttttcgcactagcaccagtcgtcttcgcggaagacccccatctacgcaaccgacccggaaaaggacacaactacatcgacggaatgacacaagaagatgcaacatgcaaaccagtcacatacgcaggcgcctgctcctccttcgacgtcctacttgagaaaggtaaattccccctctttcaaagctacgcgcaccaccgtaccctcctcgaagcagtccacgacacaatcatagcaaaggctgacccacccagctgtgacctcctctccgcccatggcaacccctgcatgaaggaaaaactcgtaatgaaaacacactgcccgaacgactaccaatccgcccactacctcaacaacgacggaaagatggcctctgttaagtgcccaccaaaatacgagctgaccgaagactgcaacttttgccgtcaaatgaccggagcctccctcaagaaagggtcatacccactccaagatctattttgccaaagctccgaggacgacggcagcaaattaaaaaccaagatgaaaggtgtatgcgaagtgggcgtccaggccctcaagaaatgcgacggccaactttccactgcacacgaagtggtacccttcgccgtgttcaaaaactccaagaaagtctatttagacaaactcgacctaaaaacggaagagaacctcctacccgactcatttgtctgctttgagcacaaaggccaatacaaaggaacaatggatagcgggcaaacaaaaagggaactcaagtccttcgacatcagccagtgccccaaaatcggcggacatgggagcaaaaagtgcaccggcgacgctgcattctgcagtgcctacgagtgcaccgcgcaatacgctaacgcatactgcagtcatgctaacggcagcggaattgtacaaatccaggtctccggcgtgtggaagaaaccactatgcgtaggctacgaacgggttgtcgtcaaaagagagctttccgccaaacccattcaacgagttgaaccatgcactacatgtatcaccaaatgtgaacctcatggtctagttgtccgctcgaccggattcaagatctcgagcgccgtagcctgcgcctccggagtgtgcgtcacaggctcacaatccccctcgacagaaattaccctgaaataccctggaatctcccagtcctcgggaggcgacataggggtacacatggcccacgacgaccaaagcgtctcctccaaaatagtagctcactgcccaccacaggacccctgtctcgtacacgactgcatagtatgtgcacatggtctcatcaactaccaatgccacacagcactcagtgcatttgtagttgtattcgtattctcctctatcgccatcatctgcctagccatactctacagggtcctcaaatgcctaaaaatcgcaccacgaaaagtcctcaaccccctaatgtggataaccgccttcatccgctggatatacaagaaaatggtcgcccgcgtcgcagacaacatcaatcaagtcaaccgtgaaatcggctggatggaaggaggacaactggtccttggaaacccagcgccaataccccgccacgccccaattcctcgatactccacctacctaatgcttctcctaatcgtatcctacgcctccgcctgcagcgaactcatacaggcttcctcacgcataactacgtgctccaccgaaggagttaacaccaaatgccgactctcagggacagccctaatcagagcgggaagtgtaggcgcagaagcctgccttatgctgaaaggagtcaaagaggaccaaacaaaattcctaaagatcaaaaccgtctcatctgagctcagctgccgcgaaggacaatcctactggacaggttccttctcccccaaatgcctgtcatcccgcagatgccatttagtcggcgagtgccatgtaaaccgatgcctctcctggcgcgacaacgagacttcagcggagttcagcttcgtaggggaatctacaaccatgcgtgagaacaagtgcttcgaacaatgcggaggctggggatgcggttgcttcaacgtcaacccatcctgcctattcgtacatacttacctccagtccgtcagaaaagaggcgctacgcgtcttcaactgtatagactgggttcacaaacttaccctggaaataaccgacttcgacggatccgtcagcacaatagatctgggagcttccagctcacgtttcacgaactgggggtccgtctcgctttctctagacgccgaaggcataagcggctccaactccttctccttcatcgaaagccccggcaaaggctacgccatcgtagacgagccattctcagagatcccccgccaaggcttcctcggcgagatcagatgtaacagcgaatcctccgtactctcagcacacgaatcctgccttcgcgcaccaaatcttatctcctacaaacccatgatcgaccaactagaatgtaccaccaatctaatagatcccttcgtagtattcgaacgcggctctctaccccaaacacgcaacgacaaaacattcgcggcctccaaagggaaccggggcgtgcaagccttctccaaaggaagtgtccaagccgatctcacactcatgttcgacaactttgaagtagacttcgtcggggcggccgtaagttgcgatgcggccttcctaaacctgaccggctgttactcatgcaacgcgggcgccagagtctgcctctccataacctccaccggaaccggatcactgtcagcacacaacaaagacggatccctacacatcgtccttccatccgaaaatggcacaaaagaccaatgccaaatcttacacttcaccgtcccagaagtagaagaagagttcatgtacagttgcgacggagatgagcgcccgttactcgtaaagggcacacttatagccattgacccgttcgacgacagacgtgaggccggaggagaaagcaccgtcgtaaatccaaagtcagggtcatggaacttcttcgactggttttccggattaatgtcctggttcggaggccctctcaaaactatactcctaatatgcctatacgtcgccctctccatcggcctattcttcctcctaatatacctcggacgcacaggcctctccaaaatgtggctagccgccaccaaaaaggcctcctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17347 - RNA, 3172 nt, synthetic construct
  misc_feature 1..3172: note = mRNA product Design1 comprising derived and/or modified sequence from RVFV(ZH-548)__DQ380206.1__Gne_SP-Gn_Gc (opt11)
  source 1..3172: mol_type = other RNA
gggagaaagcttaccatggcaggaatcgccatgacagtcctaccagcacttgccgtatttgccctcgccccagtagtatttgccgaagacccacacctcagaaaccgacccggaaaaggacacaactatatcgatggcatgacccaggaagatgcaacatgcaaacctgtaacctacgccggcgcatgctccagcttcgacgtactacttgagaaaggcaaatttccactctttcaatcttacgctcaccaccgcacccttctagaggccgtccacgacacgatcatagctaaagccgacccaccaagctgcgacctcctctcagcccatggcaacccatgcatgaaagagaaactcgtaatgaaaacccactgccccaacgactaccagtccgctcactacctcaataacgacggaaaaatggcctcagtcaaatgcccacccaaatacgagcttacagaggactgcaacttctgccgccaaatgaccggagcctcactcaagaaaggaagctacccccttcaggacctattctgccagagctcagaagacgacggtagcaagctaaaaaccaaaatgaaaggggtttgcgaggtcggcgtccaggcgctcaagaaatgcgacggtcaactctctacagcacatgaagtcgtacccttcgccgttttcaaaaacagcaagaaagtctacctcgacaaactagacctcaaaaccgaagaaaacctactccccgacagcttcgtgtgcttcgaacacaaaggccaatataaaggcacgatggactccggacagaccaaaagggaactaaaatccttcgacatatcccaatgccccaaaatcggaggccacggatccaagaaatgcaccggagacgccgccttctgctcagcatacgaatgcacagcacaatacgccaacgcatactgcagccacgcaaacggatccggaatagtgcagatccaagtaagcggagtctggaagaaacccctctgtgtcggctacgaacgcgtggtcgtaaaaagagagctttcagctaaaccaatacaacgagtagaaccctgcaccacgtgcattacaaaatgcgaaccacacggcctcgtcgttcgcagcactggtttcaaaatatctagcgcggtagcatgcgcctcaggcgtatgcgtgaccggatcccagtcaccatcaacagaaatcaccctcaaatacccgggcatttcacaatcatcaggtggcgacatcggggtacacatggcacacgacgatcaatccgtctcttcaaaaatcgtcgcccactgcccaccccaggacccctgtttagtgcacgactgtatagtctgcgcccacggcctaattaactaccaatgccacaccgccatggccggaatcgcaatgacagtcttaccggccctcgcagtattcgccctagccccagttgtcttcgcagaagactgctcagaactaatccaagcctcttcccgaatcaccacatgcagcaccgaaggcgtcaacacaaaatgccgcctctcgggcaccgccctcatacgcgcaggcagcgtcggcgccgaagcgtgcctaatgcttaaaggagtcaaagaagatcaaaccaaatttctaaaaatcaaaactgtgagctcagaactctcatgcagagaaggacaaagctactggaccggatcattttctcctaaatgcctgagctctcgcagatgccacctcgtaggagagtgccatgtcaaccgctgtctctcttggcgagacaacgagacctccgcagagttcagcttcgtaggtgaatcaacaaccatgcgagaaaacaaatgcttcgaacaatgcggtggctggggttgcggatgcttcaacgtcaacccctcatgtctcttcgtccacacatacctccaaagcgttcgcaaagaagctctacgcgtattcaattgcattgattgggtacataagctcacactagaaatcacggactttgacggctcagtctcaaccatcgatctcggtgcatccagttcgcgcttcactaactggggaagcgtctcgctttccctcgatgccgaaggcatatccggatcgaactcattctcgttcattgaatcacccggcaaaggctacgccatcgtagatgaacccttcagtgaaatcccgagacaaggattcctaggagaaatccggtgcaactccgaatcgagcgtcctctccgcacacgaatcctgcctccgcgcccctaatctcatctcctacaaaccaatgatcgatcaactcgaatgtacaacaaacctgatcgatcccttcgtcgtgtttgaacgtggctcactcccccaaacccgcaatgacaaaacgttcgccgcttctaaaggcaaccggggcgtccaggctttcagcaagggctccgtccaagccgacctcacgctcatgttcgacaacttcgaagtcgacttcgtcggagccgctgtttcctgtgacgccgcatttctaaacttaaccgggtgctacagctgcaatgccggcgcaagagtatgcctctccatcacctcaaccggaactggctccctaagcgcccacaacaaagacggctcactccacatcgtcctaccaagcgaaaacggcacgaaagaccaatgccaaatcctgcactttaccgtacccgaagtcgaagaggagttcatgtatagctgcgacggcgacgaacgaccacttctagtcaaaggcacactcatcgccatcgaccccttcgacgaccgcagagaagcaggcggtgaatcaactgtggtaaaccccaaatcaggcagctggaacttcttcgactggttctccggactcatgagctggttcggcggcccccttaagaccatcttactcatctgcctatacgtcgcactatccatcggactcttctttctactcatctacctcggccgcacaggcctctctaaaatgtggctagccgcaaccaagaaagcaagttaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17348 - RNA, 3406 nt, synthetic construct
  misc_feature 1..3406: note = mRNA product Design1 comprising derived and/or modified sequence from RVFV(ZH-548)__DQ380206.1__IgE-leader_Gn(delSP)-Gc-variant1 (opt11)
  source 1..3406: mol_type = other RNA
gggagaaagcttaccatggactggacctggatactgttcctcgtagccgccgctacccgcgtccatagtgaagacccacacctaagaaaccgccccggaaaagggcacaactacatagatggtatgacacaagaggacgcgacgtgtaaacccgtaacctatgctggagcttgtagctcctttgatgtccttctcgagaaaggaaaattccccctcttccaatcctacgcccaccacagaaccctactcgaggcagtgcatgacacaataatcgctaaagcagacccaccatcttgcgatctattatctgctcacggaaacccctgcatgaaagaaaagctagtcatgaaaacccactgccccaacgattaccaatcagcacattaccttaataacgacggcaaaatggcctccgtcaaatgtcccccaaaatacgaactcacagaggattgcaacttctgccgccagatgaccggcgcctccctcaagaaagggtcctaccctctccaagacctattctgccaatcctccgaagacgacggctccaaattaaaaacgaaaatgaaaggcgtctgcgaagtgggcgttcaagctctcaagaaatgcgacggtcaactatccaccgcacacgaagtcgttcccttcgcagtcttcaaaaattctaagaaagtctacctagacaaacttgacctaaaaaccgaagagaatctcctacccgactccttcgtctgcttcgaacacaaaggacaatacaaaggcaccatggattccggccaaacaaaacgcgaactcaaatccttcgacatctcacaatgtcccaaaataggaggtcacggatcgaagaaatgcaccggagacgctgccttctgctctgcatacgaatgcaccgcccaatatgccaacgcctactgttcacacgccaacggctccggcatagtccaaatacaagtctcgggcgtatggaagaaacccctctgcgtaggctacgagcgagtggtagtcaaaagagaactctccgccaaaccgatccaacgcgtcgagccatgcacaacgtgtattacaaaatgcgaaccacacgggctagttgtccggtcgaccgggttcaaaatctcttcagccgtagcctgcgcctcaggtgtatgcgtcaccggatcacaatccccgagcaccgaaataaccctaaaatacccggggatcagccagtcgtccggcggcgatatcggcgttcacatggcgcacgacgaccagagcgtcagcagcaaaatcgtcgcccactgtcctccccaagacccctgcctggtacacgactgcatcgtctgcgctcacggcctcataaactaccagtgccataccgccctgtccgccttcgttgtcgtattcgtcttctcctcaatcgccatcatctgcctagccatactataccgcgtactcaaatgtctaaaaatcgcaccccgcaaagtacttaaccctctaatgtggatcaccgcattcatccgctggatctataagaaaatggtagcccgggtcgccgacaacatcaaccaagtcaaccgtgaaatcggatggatggaaggcggacaactcgtcctgggcaaccccgccccaatcccgcgacacgccccaatccctcgctactccacctacctcatgctactactcatcgtaagctacgcttccgcatgctccgagctaatccaggcttcctcccgcatcacaacttgttcaacagagggcgtaaacacaaaatgtagactgtctggcacagccctaatacgtgcaggaagcgtaggagccgaagcctgcctcatgcttaaaggagtaaaagaagaccaaacgaaatttctcaaaatcaaaacagtcagttccgagctctcatgccgcgaaggccaatcctactggaccggcagtttctcccccaaatgcctaagcagtcgccgctgccacctcgtcggcgaatgccacgtaaatcgatgtttgtcatggcgagataatgaaacctccgcagagttttcatttgtaggcgaatccaccaccatgcgcgaaaacaaatgcttcgaacaatgcggaggttggggctgcggctgcttcaacgtgaacccgtcatgcctcttcgttcacacctatcttcaatccgtgcgcaaagaagcactccgcgtgtttaattgcatcgactgggtccacaaacttacccttgaaataactgacttcgacggctccgtctccacaatagacttaggagcctcatcatcaagattcaccaattggggatcagtttccctctcgctcgacgctgaaggtataagtggcagtaactcattctcattcatcgaatcacccggcaaaggctatgctatcgtagatgagcccttttccgagatcccacgacaaggatttctaggggaaattcgctgtaattcggagtcctccgtcctatcggcccacgaatcatgcctccgcgccccaaacctcatctcgtacaaacccatgatcgaccagttggaatgcaccacaaacctcattgaccccttcgtggtcttcgaacgaggaagcctcccccaaacacgcaacgacaaaaccttcgccgcctcgaagggcaaccgcggcgtacaagccttcagtaaaggatcggtccaagcagaccttaccctcatgttcgacaacttcgaggtcgacttcgttggagcggcggtgtcctgcgatgccgcattcctcaacctcacaggctgctactcctgcaacgctggagcacgcgtatgcttatcaataacctctactggaactggctcactatccgcccacaacaaggacggcagcctccacatcgtcctcccatcagaaaacggcacaaaagatcagtgccaaatactccactttacggtcccggaggtcgaagaagagttcatgtacagctgcgacggcgacgaacgccccctcctagtaaaaggtaccctgatagcaatcgaccccttcgatgaccgccgagaggccggcggggaatccacagtggtcaacccgaaatccggcagctggaacttcttcgactggttctccgggcttatgtcctggttcggcggccctctcaaaacgatactactaatctgcctatacgtcgcgctgtccataggcttattcttcctactaatataccttgggcgcactggcctctcaaagatgtggctggccgccaccaagaaggcctcctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17349 - RNA, 3400 nt, synthetic construct
  misc_feature 1..3400: note = mRNA product Design1 comprising derived and/or modified sequence from RVFV(ZH-548)__DQ380206.1__IgE-leader_Gn(delSP)-Gc-variant2 (opt11)
  source 1..3400: mol_type = other RNA
gggagaaagcttaccatggattggacgtggatcctgtttctcgtggccgccgcgaccagagtccacagcccacatctcagaaaccgcccgggcaagggacacaactacatagacggcatgacccaggaggacgcgacctgcaagcccgtgacctacgccggcgcctgtagcagcttcgacgtactgctggagaagggcaaattccccctgttccagtcctacgcacaccaccggacactgctcgaggcggtccatgacacaatcatagctaaggccgaccctccctcgtgcgaccttctatccgcgcacgggaatccctgcatgaaggagaagctcgtcatgaagacccactgtcccaacgactaccagagcgcccactacctgaacaacgacggcaaaatggcctctgtgaagtgccctcccaaatacgagctcacagaggattgcaacttctgcaggcagatgactggcgcctcgttaaagaaagggtcttaccctctgcaggacctgttctgccagagctccgaagacgacggaagcaagctcaagacgaagatgaagggcgtctgcgaggtgggcgtgcaggccctgaagaaatgcgacgggcagctgtccactgcccacgaggtcgtaccattcgcggtgttcaaaaacagcaagaaagtctacttggacaagctggatcttaagaccgaggagaacctactccccgactcttttgtgtgcttcgagcataaggggcagtataagggcacgatggacagtggacagacaaagcgagagctgaaaagtttcgacattagccagtgcccgaaaatcggcggtcacggctccaagaagtgcaccggcgacgccgccttctgctccgcctacgagtgtactgcccagtacgcgaacgcctactgcagccacgcaaatgggagtggcatagtgcagatccaggtcagcggggtatggaagaagccactatgcgtgggctacgagcgcgtggtggtgaagcgggaactgtccgctaagcccatccagcgcgtcgagccctgcaccacttgcatcaccaagtgcgagccccacgggctggtggtccggagcaccggtttcaaaatttccagcgccgtcgcgtgcgcgtccggtgtgtgcgtcaccgggagccagtcccccagcacggagatcaccctcaagtaccccggcatctcccagagctccgggggcgacatcggggtgcacatggcccacgacgaccaatctgtgtcctcaaagatcgtggcccactgccctccccaggacccctgcctggtgcacgactgcatcgtgtgcgcccacggcctgataaactaccagtgccacacggcgctcagcgcgtttgttgtagtgttcgtcttcagctccatcgccatcatctgcctagccattctgtaccgggtgctcaagtgcctgaagatcgctccccggaaagtgctgaatcctctgatgtggatcaccgccttcatccggtggatctacaagaagatggtggcccgggttgccgacaacatcaaccaagtgaaccgcgagatcggctggatggagggcgggcagctggtcctggggaacccggcccccatcccccgacacgcgcccatcccccgctactctacgtacctcatgctgctgctcatcgtgtcgtacgcctctgcatgcagcgagttgatccaggcgtccagcaggatcacaacctgcagcaccgagggcgtcaacacgaagtgccgcctgagtggaaccgccctcatccgggcgggctccgttggcgctgaggcctgcctgatgttaaagggggtaaaggaagaccaaaccaaattcttgaagatcaagaccgtcagctccgaactgagctgccgagaaggccagtcctactggacggggtctttcagtcccaagtgcctgagctcccgacgctgccatctcgtcggtgagtgccacgtcaaccgctgcctctcatggcgggacaacgagacatccgccgagttctcatttgtgggcgagtccaccaccatgcgcgagaacaagtgctttgagcagtgcggtggctggggctgcggatgcttcaacgtcaacccctcctgcctgttcgtccatacgtacctgcagagcgtgcggaaggaggccctcagggtcttcaactgcatcgactgggtgcacaagctgaccctggagatcaccgacttcgacggctctgtgtccaccattgacttgggcgcgtccagcagcagatttacgaactggggcagcgtcagtctcagcctggacgccgaggggatctccggcagtaactccttctcgttcatcgagtccccggggaagggctacgccatcgtagacgagcccttctcagagatcccccgccaggggtttctcggcgagattcgctgcaactccgaaagctcagttttgagcgcccacgaaagctgtctgcgcgcgcctaacctcatctcctacaagcccatgatcgaccagctggagtgcacgaccaacctgatcgaccccttcgtggtcttcgagcggggcagcctcccccagacccgcaacgacaagaccttcgccgcctcaaaagggaacaggggcgtgcaagccttctcaaaggggtccgtacaagccgaccttacgctgatgttcgacaactttgaggttgacttcgtgggcgcggccgttagctgcgacgccgcgtttctcaacctgaccggatgttacagttgcaatgcgggggcacgcgtctgcctttctatcaccagcaccggcacggggagcctctccgcccacaacaaggacggctcgctacacatcgtattaccgagcgagaacgggaccaaggaccagtgccagattctccacttcaccgtaccggaggtggaggaggagttcatgtactcctgcgacggtgacgaacggcccctactggtaaaagggaccctaatcgccatcgaccccttcgacgaccgccgcgaggcgggcggcgagtccacggtcgtgaaccccaaaagcgggtcctggaacttcttcgactggttcagcggcctgatgagctggttcgggggcccgttaaagactatcctccttatttgcctgtatgtggcgctcagcatcggcctgttctttttattaatatacctggggcgcaccggcctgagcaagatgtggctcgcggctacaaagaaggcctcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17350 - RNA, 1885 nt, synthetic construct
  misc_feature 1..1885: note = mRNA product Design1 comprising derived and/or modified sequence from RVFV(ZH-548)__DQ380206.1__IgE-leader_Gn(delSP)-variant1 (opt11)
  source 1..1885: mol_type = other RNA
gggagaaagcttaccatggactggacctggatcctcttcctagtcgccgcagccacccgcgtccactccgaagacccacacctacggaaccgcccaggaaaaggacacaactacattgacggcatgacccaagaggacgcaacctgcaaaccagtaacatacgccggcgcctgctcctccttcgacgtcctcctagaaaaaggcaaattcccactattccaatcctacgcccaccaccgaacactgctcgaagccgtacacgacaccatcatagcaaaagccgacccaccttcctgcgacctcctctccgcccacggcaacccctgcatgaaggaaaaactcgtcatgaagacccactgccccaacgactaccagagcgcccactacctcaacaacgacggcaagatggctagcgtcaagtgtcccccaaaatacgaactcactgaagactgcaacttctgccgccaaatgacaggggcatctctcaagaaaggctcctacccactccaagacctgttctgccaatcaagcgaagacgacggatccaaactcaaaaccaaaatgaaaggagtctgcgaagttggcgtccaagccctcaagaaatgcgatggccaactatcaacagctcacgaagtcgtccccttcgccgtcttcaaaaactctaagaaagtctacctcgacaaactcgacctcaaaaccgaagaaaacctactccccgattcattcgtctgcttcgaacacaaaggccagtacaaaggaaccatggactcaggccaaacaaaacgcgaactaaaatcattcgacatctcacaatgcccaaaaatcggtggacacggctcaaagaaatgcaccggagatgcggccttctgcagcgcctacgaatgcaccgctcaatatgcaaacgcctactgctcccacgccaacggctcaggaatcgtccagatccaagtatccggagtctggaagaaacccctatgcgtcggctacgaacgcgtagtagtaaaacgagaactctccgccaaacctatacaacgcgtagaaccctgcacaacatgcataacaaaatgcgagccccacggcctagtcgtccgctccaccggattcaaaatttcctctgcagtcgcatgcgcctcaggagtctgcgtcacaggctcacaatcgccctcaaccgaaatcactctcaaatacccaggcatcagccaaagctccggcggagacatcggagtccacatggcccacgacgaccaatccgtctccagcaaaatagtggcacactgccctccacaggatccctgcctcgttcacgactgcatcgtctgcgcccacggcctcataaactaccaatgccacaccgccctctccgcgttcgtcgtcgttttcgtattctcgtccatcgcaatcatctgccttgcaatcctctaccgggtcctcaaatgtctaaaaatcgcaccccgaaaagtcctcaaccctctaatgtggataacagccttcataagatggatctacaagaaaatggtcgcccgcgtagccgacaacatcaaccaggtcaaccgagaaatcggctggatggaaggaggccaactcgtcctcggcaacccagcccctatcccacgacacgcacccatcccccgctactccacctacctcatgctcctactcatagtatcctacgcctccgcctagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17351 - RNA, 1879 nt, synthetic construct
  misc_feature 1..1879: note = mRNA product Design1 comprising derived and/or modified sequence from RVFV(ZH-548)__DQ380206.1__IgE-leader_Gn(delSP)-variant2 (opt11)
  source 1..1879: mol_type = other RNA
gggagaaagcttaccatggactggacctggatcctcttcctcgtcgctgcagcaacacgcgtccactcgccacaccttcgcaacagaccaggcaaaggccacaactacatagacggaatgacacaagaagacgcaacctgcaaacccgtcacatacgccggcgcatgctcatccttcgacgtcctactagaaaagggcaaattccccctattccaatcctacgcccaccaccgaaccctcctagaagccgtccacgacaccatcatagcaaaggccgatcctccctcctgcgacctgctgtcagcacacggcaatccctgcatgaaagaaaagctagtcatgaaaacacactgccccaacgactaccaaagcgcccactatctcaacaacgacggcaaaatggcatcagtcaaatgcccacccaaatacgaactgaccgaagactgtaacttctgccgccaaatgaccggcgcctctctcaagaaaggatcataccccctccaagacctattctgccaatccagtgaagacgacggatccaaactcaaaaccaaaatgaaaggcgtctgcgaagttggagtgcaggccctcaagaaatgcgacggccaactttccaccgcccatgaggtagtacccttcgccgtattcaaaaactcgaagaaagtatacctagacaaactcgacttaaaaaccgaagaaaacctcctccccgactcattcgtctgcttcgaacacaaaggccaatacaaaggcaccatggactccggacaaaccaaacgcgaactcaaatccttcgacatcagccaatgtcccaaaataggaggacacggcagcaagaaatgcaccggcgacgccgcattttgctcagcctacgaatgcacagcacaatacgcaaacgcatactgctcacacgcaaacggctccggaatcgtccaaatccaagtatccggtgtttggaagaaacccctctgcgtcggatacgaacgcgtcgttgtcaaaagagaactctcagccaaaccaatccaacgcgtcgaaccctgcacaacctgcatcaccaaatgcgaacctcacgggctagtcgtccgatccaccggtttcaaaatctcaagcgccgtcgcctgtgccagcggtgtatgcgtaaccggatcccaatctccatcaaccgaaatcactctaaaataccccggaataagccagtcctccggaggagacataggcgtccacatggcacacgacgaccaatcagtctcatccaaaatagtagcacactgcccgccacaagacccatgcctagtccacgattgcatcgtctgcgcccacggcctaatcaactatcaatgccacaccgcactcagcgcattcgtggtcgtcttcgtcttctccagcatcgcaatcatatgcctcgccatcctctaccgcgtactcaaatgcctaaaaatagcccctcgaaaagttctcaaccccctcatgtggatcaccgcttttatccgatggatctacaagaaaatggtagctcgagtcgccgataacatcaaccaagtaaaccgcgaaatcggatggatggaaggcggccaactcgtcctaggaaatccggcccccatacctagacacgcacccatccctcgctactcaacctaccttatgctactccttatagtatcttacgcatccgcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17352 - RNA, 1795 nt, synthetic construct
  misc_feature 1..1795: note = mRNA product Design1 comprising derived and/or modified sequence from RVFV(ZH-548)__DQ380206.1__IgE-leader_Gc (opt11)
  source 1..1795: mol_type = other RNA
gggagaaagcttaccatggactggacatggatcctcttcctcgtggccgcagccacaagagtccactcgtgctccgaacttatccaagcctccagccgaatcacaacctgcagcaccgaaggcgtaaataccaaatgccgactctccggcaccgccctaatccgcgcaggctcagtaggcgccgaagcctgccttatgctcaaaggagtcaaagaagaccaaaccaaattcctcaaaatcaagaccgtaagcagcgaactaagctgccgagaaggccagagctattggacaggctcattctcacccaaatgcctcagttcccgcagatgccacctagtcggcgaatgccacgtcaaccggtgcctctcatggcgggacaacgaaaccagcgcggaatttagcttcgtaggagaatcaactaccatgcgagaaaataagtgcttcgagcaatgcggcggctggggatgcggctgcttcaacgtaaacccctcatgcctattcgtccacacatacctccaatccgtccgcaaggaagccctacgcgtctttaactgcattgactgggtgcacaaacttacactcgaaatcacggacttcgacggcagcgtcagcacaatagacctcggcgcctccagctcccgcttcaccaattggggctccgtaagcctctccctggacgcagaaggcatctcaggctccaattcgttctccttcatagaatcacctgggaaaggctacgccatcgtagacgaacccttcagcgaaattccacgccaaggcttcctaggagaaatccgctgcaactctgaatcaagcgtactctccgcccacgaatcctgtctacgcgcccccaatctaatcagctacaaacccatgattgaccaactcgaatgcacaaccaatttaatcgacccatttgtcgtcttcgagcgcggatcactaccacaaacccgaaacgacaaaaccttcgcagcaagcaagggaaaccgcggtgtacaagccttcagcaaaggctccgtccaagcagaccttacactaatgttcgacaacttcgaagtcgacttcgtcggcgccgccgtcagctgcgacgccgccttcctgaacctcacgggctgttacagctgcaacgccggcgcacgcgtctgcctatctatcacctcgaccggcacaggatcactatccgcacacaacaaagacggatcgctccacatcgtactcccaagcgaaaacggcaccaaggaccagtgccaaatcctgcacttcaccgtaccagaagtagaagaagagttcatgtactcatgcgacggcgacgaaagaccactgctcgtgaaaggcacccttatagcgatcgacccattcgacgaccgacgagaagcaggaggcgaatcaacagttgtaaaccccaaaagcggaagttggaacttcttcgactggttcagcgggctcatgagctggttcggaggaccactcaaaaccatactcctcatctgcctctacgtcgcactcagcatcgggcttttcttcctcctcatctacctgggccgcaccggactatcaaaaatgtggctcgccgccaccaagaaagcaagctaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17353 - RNA, 1120 nt, synthetic construct
  misc_feature 1..1120: note = mRNA product Design2 comprising derived and/or modified sequence from RVFV(ZH-548)__DQ380151.1__N (wt)
  source 1..1120: mol_type = other RNA
ggggcgctgcctacggaggtggcagccatctccttctcggcatcaagcttaccatggacaactatcaagagcttgcgatccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagaattcttgaaagcctttggacttgtggattccaatgggaagccgtcagctgctgtcatggcagccgctcaggcttacaagacagcagcctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17354 - RNA, 1120 nt, synthetic construct
  misc_feature 1..1120: note = mRNA product Design2 comprising derived and/or modified sequence from RVFV(ZH-548)__DQ380151.1__N (wt)
  source 1..1120: mol_type = other RNA
ggggcgctgcctacggaggtggcagccatctccttctcggcatcaagcttaccatggacaactatcaagagcttgcgatccagtttgctgctcaagcagtggaccgcaatgagattgaacagtgggtccgagagtttgcttatcaagggtttgatgcccgtagagttatcgaactcttaaagcagtatggtggggctgactgggagaaggatgccaagaaaatgattgttctggctctaactcgtggcaacaagcccaggaggatgatgatgaaaatgtcgaaagaaggcaaagcaactgtggaggctctcatcaacaagtataagctaaaggaagggaatccttcccgggatgagttgactctatcacgagttgctgccgccttggctggctggacatgccaggctttggtcgtcttgagtgagtggcttcctgtcactgggactaccatggacggcctatcccctgcatacccgaggcatatgatgcaccccagctttgctggcatggtggatccttctctaccaggagactatctaagggcaatattagatgctcactctctgtatctgctgcagttctcccgggtcatcaacccaaacctccgaggtagaacaaaagaggaggttgctgcaacgttcacgcagccaatgaatgcagcagtgaatagcaactttataagccatgagaagaggagagagttcttgaaagcctttggacttgtggattccaatgggaagccgtcagctgctgtcatggcagccgctcaggcttacaagacagcagcctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17355 - RNA, 3976 nt, synthetic construct
  misc_feature 1..3976: note = mRNA product Design2 comprising derived and/or modified sequence from RVFV(ZH-548)__DQ380206.1__GP (wt)
  source 1..3976: mol_type = other RNA
ggggcgctgcctacggaggtggcagccatctccttctcggcatcaagcttaccatgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgccatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17356 - RNA, 3976 nt, synthetic construct
  misc_feature 1..3976: note = mRNA product Design2 comprising derived and/or modified sequence from RVFV(ZH-548)__DQ380206.1__GP (wt)
  source 1..3976: mol_type = other RNA
ggggcgctgcctacggaggtggcagccatctccttctcggcatcaagcttaccatgtatgttttattaacaattctaatctcggttctggtgtgtgaagcggttattagagtgtctctaagctccacaagagaagagacctgctttggtgactccactaacccagagatgattgaaggagcttgggattcactcagagaggaggagatgccggaggagctctcctgttctatatcaggcataagagaggttaagacctcaagccaggagttatacagggcattaaaagccatcattgctgctgatggcttgaacaacatcacctgtcatggtaaggatcctgaggacaagatttccctcataaagggtcctcctcacaaaaagcgggtggggatagttcggtgtgagagacgaagagatgctaagcaaatagggagagaaaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17357 - RNA, 3586 nt, synthetic construct
  misc_feature 1..3586: note = mRNA product Design2 comprising derived and/or modified sequence from RVFV(ZH-548)__DQ380206.1__Gn-Gc (wt)
  source 1..3586: mol_type = other RNA
ggggcgctgcctacggaggtggcagccatctccttctcggcatcaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17358 - RNA, 3586 nt, synthetic construct
  misc_feature 1..3586: note = mRNA product Design2 comprising derived and/or modified sequence from RVFV(ZH-548)__DQ380206.1__Gn-Gc (wt)
  source 1..3586: mol_type = other RNA
ggggcgctgcctacggaggtggcagccatctccttctcggcatcaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17359 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (wt)
  source 1..3337: mol_type = other RNA
ggggcgctgcctacggaggtggcagccatctccttctcggcatcaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctatggcagggattgcaatgacagtccttccagccttagcagtttttgctttggcacctgttgtttttgctgaagactgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17360 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (wt)
  source 1..3337: mol_type = other RNA
ggggcgctgcctacggaggtggcagccatctccttctcggcatcaagcttaccatggcagggattgcaatgacagtccttccagccttagcagtttttgctttggcacctgttgtttttgctgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctatggcagggattgcaatgacagtccttccagccttagcagtttttgctttggcacctgttgtttttgctgaagactgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17361 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (wt)
  source 1..3571: mol_type = other RNA
ggggcgctgcctacggaggtggcagccatctccttctcggcatcaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17362 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (wt)
  source 1..3571: mol_type = other RNA
ggggcgctgcctacggaggtggcagccatctccttctcggcatcaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17363 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (wt)
  source 1..3565: mol_type = other RNA
ggggcgctgcctacggaggtggcagccatctccttctcggcatcaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17364 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (wt)
  source 1..3565: mol_type = other RNA
ggggcgctgcctacggaggtggcagccatctccttctcggcatcaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17365 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (wt)
  source 1..2050: mol_type = other RNA
ggggcgctgcctacggaggtggcagccatctccttctcggcatcaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17366 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (wt)
  source 1..2050: mol_type = other RNA
ggggcgctgcctacggaggtggcagccatctccttctcggcatcaagcttaccatggactggacctggatcctgttcctcgtggccgccgcgacccgcgtccacagcgaagacccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17367 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (wt)
  source 1..2044: mol_type = other RNA
ggggcgctgcctacggaggtggcagccatctccttctcggcatcaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagcttgaccttaagactgaggagaatctgctaccagactcatttgtctgtttcgagcataagggacagtacaaaggaacaatggactctggtcagactaagagggagctcaaaagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17368 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (wt)
  source 1..2044: mol_type = other RNA
ggggcgctgcctacggaggtggcagccatctccttctcggcatcaagcttaccatggactggacctggatcctgttcctcgtggccgccgcgacccgcgtccacagcccccatctcagaaacagaccagggaaggggcacaactacattgacgggatgactcaggaggatgccacatgcaaacctgtgacatatgctggggcatgtagcagttttgatgtcttgcttgaaaagggaaaatttccccttttccagtcgtatgctcatcatagaactctactagaggcagttcacgacaccatcattgcaaaggctgatccacctagctgtgaccttctgagtgctcatgggaacccctgcatgaaagagaaactcgtgatgaagacacactgtccaaatgactaccagtcagctcattacctcaacaatgacgggaaaatggcttcagtcaagtgccctcctaagtatgagctcactgaggactgcaacttttgtaggcagatgacaggtgctagcctgaagaaggggtcttatcctctccaagacttgttttgtcagtcaagtgaggatgatggatcaaaattaaaaacaaaaatgaaaggggtctgcgaagtgggggttcaagcactcaaaaagtgtgatggccaactcagcactgcacatgaggttgtgccctttgcagtgtttaagaactcaaagaaggtttatcttgataagctggaccttaagactgaggagaatctgctaccagactcatttgtctgtttcgagcataagggacagtacaaaggaacaatggactctggtcagactaagagggagctcaagagctttgatatctctcagtgccccaagattggaggacatggtagtaagaagtgcactggggacgcagcattttgctctgcttatgagtgcactgctcagtacgccaatgcctattgttcacatgctaatgggtcagggattgtgcagatacaagtatcaggggtctggaagaagcctttatgtgtagggtatgagagagtggttgtgaagagagaactctctgccaagcccatccagagagttgagccttgcacaacttgtataaccaaatgtgagcctcatggattggttgtccgatcaacagggttcaagatatcatcagcagttgcttgtgctagcggagtttgcgtcacaggatcgcagagtccttccaccgagattacactcaagtatccagggatatcccagtcttctgggggggacataggggttcacatggcacacgatgatcagtcagttagctccaaaatagtagctcactgccctccccaggacccgtgcttagtgcatgactgcatagtgtgtgctcatggcctgataaattaccagtgtcacactgctctcagtgcctttgttgttgtgtttgtattcagttctattgcaataatttgtttagctattctttatagggtgcttaagtgcctgaagattgccccaaggaaagttctgaatccactaatgtggatcacagccttcatcagatggatatataagaagatggttgccagagtggcagacaacattaatcaagtgaacagggaaataggatggatggaaggaggtcagttggttctagggaaccctgcccctattcctcgtcatgccccaatcccacgttatagcacatacctgatgttattattgattgtctcatatgcatcagcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17369 - RNA, 1960 nt, synthetic construct
  misc_feature 1..1960: note = mRNA product Design2 comprising derived and/or modified sequence from RVFV(ZH-548)__DQ380206.1__IgE-leader_Gc (wt)
  source 1..1960: mol_type = other RNA
ggggcgctgcctacggaggtggcagccatctccttctcggcatcaagcttaccatggactggacctggatcctgttcctcgtggccgccgcgacccgcgtccacagctgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaagctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17370 - RNA, 1960 nt, synthetic construct
  misc_feature 1..1960: note = mRNA product Design2 comprising derived and/or modified sequence from RVFV(ZH-548)__DQ380206.1__IgE-leader_Gc (wt)
  source 1..1960: mol_type = other RNA
ggggcgctgcctacggaggtggcagccatctccttctcggcatcaagcttaccatggactggacctggatcctgttcctcgtggccgccgcgacccgcgtccacagctgttcagaactgattcaggcaagctccagaatcaccacttgctctacagagggtgttaacaccaagtgtagactgtctggcacagcattgatcagagcagggtcagttggggcagaggcttgtttgatgttgaagggggtcaaggaagatcaaaccaagttcttaaagataaaaactgtctcaagtgagctatcatgcagggagggccagagttattggactgggtcctttagccctaaatgtttgagctcaaggagatgccaccttgtcggggaatgccatgtgaataggtgtctgtcttggagggacaatgaaacttcagcagagttttcatttgttggggaaagcacgaccatgcgagagaataagtgttttgagcaatgtggaggatgggggtgtgggtgtttcaatgtgaacccatcttgcttatttgtgcacacgtatctgcagtcagttagaaaagaggcccttagagtttttaactgtatcgactgggtgcataaactcactctagagatcacagactttgatggctctgtttcaacaatagacttgggagcatcatctagccgtttcacaaactggggttcagttagcctctcactggacgcagagggcatttcaggctcaaatagcttttctttcattgagagcccaggcaaagggtatgcaattgttgatgagccattctcagaaattcctcggcaagggttcttgggggagatcaggtgcaattcagagtcctcagtcctgagtgctcatgaatcatgccttagggcaccaaaccttatctcatacaagcccatgatagatcaattggagtgcacaacaaatctgattgatccctttgttgtctttgagaggggttctctgccacagacaaggaatgacaaaacctttgcagcttcaaaaggaaatagaggtgttcaggctttctctaagggctctgtacaagctgatctaactctgatgtttgacaattttgaggtggactttgtgggagcagccgtatcttgtgatgccgccttcttaaatttgacaggttgctattcttgcaatgcaggggccagggtctgcctgtctatcacatccacaggaactggatctctctctgcccacaataaggatgggtctctgcatatagtccttccatcagagaatggaacaaaagaccagtgtcagatactacacttcactgtgcctgaagtagaggaggagtttatgtactcttgtgatggagatgagcggcctctgttggtgaaggggaccctgatagccattgatccatttgatgataggcgggaagcagggggggaatcaacagttgtgaatccaaaatctggatcttggaatttctttgactggttttctggactcatgagttggtttggagggcctcttaaaactatactcctcatttgcctgtatgttgcattatcaattgggctctttttcctccttatatatcttggaagaacaggcctctctaaaatgtggcttgctgccactaagaaggcctcatagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17371 - RNA, 1120 nt, synthetic construct
  misc_feature 1..1120: note = mRNA product Design2 comprising derived and/or modified sequence from RVFV(ZH-548)__DQ380151.1__N (opt4)
  source 1..1120: mol_type = other RNA
ggggcgctgcctacggaggtggcagccatctccttctcggcatcaagcttaccatggacaactaccaggagctggccatccagttcgccgcccaggccgtggacagaaacgagatcgagcagtgggtgagagagttcgcctaccagggcttcgacgccagaagagtgatcgagctgctgaagcagtacggcggcgccgactgggagaaggacgccaagaagatgatcgtgctggccctgaccagaggcaacaagcccagaagaatgatgatgaagatgagcaaggagggcaaggccaccgtggaggccctgatcaacaagtacaagctgaaggagggcaaccccagcagagacgagctgaccctgagcagagtggccgccgccctggccggctggacctgccaggccctggtggtgctgagcgagtggctgcccgtgaccggcaccaccatggacggcctgagccccgcctaccccagacacatgatgcaccccagcttcgccggcatggtggaccccagcctgcccggcgactacctgagagccatcctggacgcccacagcctgtacctgctgcagttcagcagagtgatcaaccccaacctgagaggcagaaccaaggaggaggtggccgccaccttcacccagcccatgaacgccgccgtgaacagcaacttcatcagccacgagaagagaagagagttcctgaaggccttcggcctggtggacagcaacggcaagcccagcgccgccgtgatggccgccgcccaggcctacaagaccgccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17372 - RNA, 3976 nt, synthetic construct
  misc_feature 1..3976: note = mRNA product Design2 comprising derived and/or modified sequence from RVFV(ZH-548)__DQ380206.1__GP (opt4)
  source 1..3976: mol_type = other RNA
ggggcgctgcctacggaggtggcagccatctccttctcggcatcaagcttaccatgtacgtgctgctgaccatcctgatcagcgtgctggtgtgcgaggccgtgatcagagtgagcctgagcagcaccagagaggagacctgcttcggcgacagcaccaaccccgagatgatcgagggcgcctgggacagcctgagagaggaggagatgcccgaggagctgagctgcagcatcagcggcatcagagaggtgaagaccagcagccaggagctgtacagagccctgaaggccatcatcgccgccgacggcctgaacaacatcacctgtcacggcaaggaccccgaggacaagatcagcctgatcaagggccccccccacaagaagagagtgggcatcgtgagatgcgagagaagaagagacgccaagcagatcggcagagagaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17373 - RNA, 3586 nt, synthetic construct
  misc_feature 1..3586: note = mRNA product Design2 comprising derived and/or modified sequence from RVFV(ZH-548)__DQ380206.1__Gn-Gc (opt4)
  source 1..3586: mol_type = other RNA
ggggcgctgcctacggaggtggcagccatctccttctcggcatcaagcttaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17374 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (opt4)
  source 1..3337: mol_type = other RNA
ggggcgctgcctacggaggtggcagccatctccttctcggcatcaagcttaccatggccggcatcgccatgaccgtgctgcccgccctggccgtgttcgccctggcccccgtggtgttcgccgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccatggccggcatcgccatgaccgtgctgcccgccctggccgtgttcgccctggcccccgtggtgttcgccgaggactgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17375 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (opt4)
  source 1..3571: mol_type = other RNA
ggggcgctgcctacggaggtggcagccatctccttctcggcatcaagcttaccatggactggacctggatcctgttcctggtggccgccgccaccagagtgcacagcgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17376 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (opt4)
  source 1..3565: mol_type = other RNA
ggggcgctgcctacggaggtggcagccatctccttctcggcatcaagcttaccatggactggacctggatcctgttcctggtggccgccgccaccagagtgcacagcccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17377 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (opt4)
  source 1..2050: mol_type = other RNA
ggggcgctgcctacggaggtggcagccatctccttctcggcatcaagcttaccatggactggacctggatcctgttcctggtggccgccgccaccagagtgcacagcgaggacccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17378 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (opt4)
  source 1..2044: mol_type = other RNA
ggggcgctgcctacggaggtggcagccatctccttctcggcatcaagcttaccatggactggacctggatcctgttcctggtggccgccgccaccagagtgcacagcccccacctgagaaacagacccggcaagggccacaactacatcgacggcatgacccaggaggacgccacctgtaagcccgtgacctacgccggcgcctgcagcagcttcgacgtgctgctggagaagggcaagttccccctgttccagagctacgcccaccacagaaccctgctggaggccgtgcacgacaccatcatcgccaaggccgacccccccagctgcgacctgctgagcgcccacggcaacccctgcatgaaggagaagctggtgatgaagacccactgccccaacgactaccagagcgcccactacctgaacaacgacggcaagatggccagcgtgaagtgcccccccaagtacgagctgaccgaggactgcaacttctgcagacagatgaccggcgccagcctgaagaagggcagctaccccctgcaggacctgttctgccagagcagcgaggacgacggcagcaagctgaagaccaagatgaagggcgtgtgcgaggtgggcgtgcaggccctgaagaagtgcgacggccagctgagcaccgcccacgaggtggtgcccttcgccgtgttcaagaacagcaagaaggtgtacctggacaagctggacctgaagaccgaggagaacctgctgcccgacagcttcgtgtgcttcgagcacaagggccagtacaagggcaccatggacagcggccagaccaagagagagctgaagagtttcgacatcagccagtgccccaagatcggcggccacggcagcaagaagtgcaccggcgacgccgccttctgcagcgcctacgagtgcaccgcccagtacgccaacgcctactgcagccacgccaacggcagcggcatcgtgcagatccaggtgagcggcgtgtggaagaagcccctgtgcgtgggctacgagagagtggtggtgaagagagagctgagcgccaagcccatccagagagtggagccctgcaccacctgtatcaccaagtgcgagccccacggcctggtggtgagaagcaccggcttcaagatcagcagcgccgtggcctgcgccagcggcgtgtgcgtgaccggcagccagagccccagcaccgagatcaccctgaagtaccccggcatcagccagagcagcggcggcgacatcggcgtgcacatggcccacgacgaccagagcgtgagcagcaagatcgtggcccactgccccccccaggacccctgcctggtgcacgactgcatcgtgtgcgcccacggcctgatcaactaccagtgccacaccgccctgagcgccttcgtggtggtgttcgtgttcagcagcatcgccatcatctgcctggccatcctgtacagagtgctgaagtgcctgaagatcgcccccagaaaggtgctgaaccccctgatgtggatcaccgccttcatcagatggatctacaagaagatggtggccagagtggccgacaacatcaaccaggtgaacagagagatcggctggatggagggcggccagctggtgctgggcaaccccgcccccatccccagacacgcccccatccccagatacagcacctacctgatgctgctgctgatcgtgagctacgccagcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17379 - RNA, 1960 nt, synthetic construct
  misc_feature 1..1960: note = mRNA product Design2 comprising derived and/or modified sequence from RVFV(ZH-548)__DQ380206.1__IgE-leader_Gc (opt4)
  source 1..1960: mol_type = other RNA
ggggcgctgcctacggaggtggcagccatctccttctcggcatcaagcttaccatggactggacctggatcctgttcctggtggccgccgccaccagagtgcacagctgcagcgagctgatccaggccagcagcagaatcaccacctgtagcaccgagggcgtgaacaccaagtgcagactgagcggcaccgccctgatcagagccggcagcgtgggcgccgaggcctgcctgatgctgaagggcgtgaaggaggaccagaccaagttcctgaagatcaagaccgtgagcagcgagctgagctgcagagagggccagagctactggaccggcagcttcagccccaagtgcctgagcagcagaagatgccacctggtgggcgagtgccacgtgaacagatgcctgagctggagagacaacgagaccagcgccgagttcagcttcgtgggcgagagcaccaccatgagagagaacaagtgcttcgagcagtgcggcggctggggctgcggctgcttcaacgtgaaccccagctgcctgttcgtgcacacctacctgcagagcgtgagaaaggaggccctgagagtgttcaactgcatcgactgggtgcacaagctgaccctggagatcaccgacttcgacggcagcgtgagcaccatcgacctgggcgccagcagcagcagattcaccaactggggcagcgtgagcctgagcctggacgccgagggcatcagcggcagcaacagcttcagcttcatcgagagccccggcaagggctacgccatcgtggacgagcccttcagcgagatccccagacagggcttcctgggcgagatcagatgcaacagcgagagcagcgtgctgagcgcccacgagagctgcctgagagcccccaacctgatcagctacaagcccatgatcgaccagctggagtgcaccaccaacctgatcgaccccttcgtggtgttcgagagaggcagcctgccccagaccagaaacgacaagaccttcgccgccagcaagggcaacagaggcgtgcaggccttcagcaagggcagcgtgcaggccgacctgaccctgatgttcgacaacttcgaggtggacttcgtgggcgccgccgtgagctgcgacgccgccttcctgaacctgaccggctgctacagctgcaacgccggcgccagagtgtgcctgagcatcaccagcaccggcaccggcagcctgagcgcccacaacaaggacggcagcctgcacatcgtgctgcccagcgagaacggcaccaaggaccagtgccagatcctgcacttcaccgtgcccgaggtggaggaggagttcatgtacagctgcgacggcgacgagagacccctgctggtgaagggcaccctgatcgccatcgaccccttcgacgacagaagagaggccggcggcgagagcaccgtggtgaaccccaagagcggcagctggaacttcttcgactggttcagcggcctgatgagctggttcggcggccccctgaagaccatcctgctgatctgcctgtacgtggccctgagcatcggcctgttcttcctgctgatctacctgggcagaaccggcctgagcaagatgtggctggccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17380 - RNA, 1120 nt, synthetic construct
  misc_feature 1..1120: note = mRNA product Design2 comprising derived and/or modified sequence from RVFV(ZH-548)__DQ380151.1__N (opt3)
  source 1..1120: mol_type = other RNA
ggggcgctgcctacggaggtggcagccatctccttctcggcatcaagcttaccatggacaactaccaggagctggccatccaattcgctgcacaggccgtggatagaaatgaaattgagcagtgggtcagggaatttgcgtatcagggcttcgacgctcggcgcgttatagagctccttaagcaatacgggggagccgattgggaaaaagacgcaaagaaaatgatcgtgctggccttgacccgaggtaacaagccccgtagaatgatgatgaaaatgagcaaggagggcaaggctacagtagaggcattaattaataaatataagctgaaagaagggaacccttccagggatgagctaactctctctcgggtggccgctgccctggcgggatggacgtgccaggcacttgtcgtgctgtcagaatggttgccagttaccggcacaactatggacggtctcagtccggcctacccccgccacatgatgcatcctagctttgctgggatggtggatccatccctgcccggagactatctgagagccatcctcgatgcacactctttatacctgcttcagttctcgagggtcattaatcctaacttgcggggccgcaccaaggaggaggtggctgccacatttacccagccaatgaatgcggccgtaaactcaaatttcatcagccatgaaaaacgaagagagtttctgaaggcattcggcctagttgacagtaacgggaagccctccgctgccgtgatggctgccgcacaagcctataaaactgctgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17381 - RNA, 3976 nt, synthetic construct
  misc_feature 1..3976: note = mRNA product Design2 comprising derived and/or modified sequence from RVFV(ZH-548)__DQ380206.1__GP (opt3)
  source 1..3976: mol_type = other RNA
ggggcgctgcctacggaggtggcagccatctccttctcggcatcaagcttaccatgtacgtgctgctcaccatccttattagcgtcctggtttgcgaggccgtgataagagtatccttgtcttcaacaagggaagagacttgtttcggcgacagtacgaaccccgaaatgatcgagggggcttgggatagcttacgggaagaggagatgcctgaagaactgtcctgctctatttcgggaatccgcgaagtgaagacctcaagccaggagctatatcgagcactcaaagccattatcgcggctgacggtctgaataacataacatgtcacggcaaggatccagaggacaaaatcagtcttattaaggggccgccccataaaaagcgtgtcggaatcgtgagatgcgaaaggcggcgcgatgccaagcaaattggcagagagactatggcaggtatcgccatgaccgttctgcctgctttggcagtgtttgccctcgctccagtcgtgttcgccgaagacccccacctgaggaatcggcctgggaaaggacataactacatagatggcatgacacaggaggacgcgacctgtaagccagtaacttatgcaggcgcctgctcctcttttgatgttctgctcgaaaaagggaagttccccttatttcagagctacgctcaccatcgcacactgcttgaggccgtgcacgacaccattatcgcaaaagctgatcctccatcctgtgacttgctgtcagcccacggaaatccgtgcatgaaggagaagctagtcatgaaaacgcattgtcccaacgattatcagagtgcgcactacctcaataacgacggtaagatggccagcgtgaaatgccctccaaagtatgaactgactgaggactgtaatttctgccgacaaatgaccggcgcatctcttaaaaaggggtcctaccccctgcaggatttgttttgccagtcaagcgaagacgatggaagtaaactcaagacaaagatgaaaggcgtgtgtgaggtcggtgttcaggctctgaagaaatgcgacgggcaattatctactgcccatgaagtggtacctttcgctgtgtttaagaactccaaaaaggtctacctggataagctcgaccttaaaaccgaggagaatctgttgccagatagcttcgtgtgttttgaacacaagggacagtataaaggcacaatggactcgggccagaccaagagagagctaaaatctttcgatatttcccagtgccccaagatcgggggacacggttcaaagaaatgtacgggcgacgccgcattttgcagtgcctacgaatgtactgctcaatatgcgaacgcatactgcagccatgccaatgggtccggaatcgttcagattcaggtgtctggcgtctggaagaaaccgctgtgtgtgggttatgagagggtagttgtgaagcgggaactcagcgctaaacctatacaacgtgtcgagccctgcacaacctgtatcactaagtgcgagccacacgggctggtggtccgctcaacaggcttcaagattagttccgccgtggcatgcgccagcggagtttgtgtgaccggctctcagtcacctagtacggaaatcacccttaaataccccgggataagccagtcctctggaggtgatattggcgtacatatggctcacgacgaccagtcggtcagctccaagatcgtggcccattgcccaccccaagatccttgtctggttcacgactgcatcgtgtgtgcacacgggttgattaactatcagtgccatacagcgctctcagctttcgtcgtggtatttgtgttcagttctatcgccattatatgtctggcaatcttatacagagttctgaaatgcctaaagattgccccaaggaaagtcctcaatccgctgatgtggatcactgcttttatccggtggatttacaagaaaatggtggcccgagtggcagataacataaaccaggtcaatcgcgagatcggatggatggaaggcggtcagcttgttttggggaaccccgctcctattccaagacacgcccccatccctaggtatagcacctacctgatgctcctgcttattgtgtcctatgcgtcagcctgtagcgagctgatccaggcttcttcccggataacaacttgcagtaccgagggcgtgaatacaaagtgtcgcttgagcggaaccgcactcatcagagccggctctgtaggggctgaagcctgcctgatgttaaagggagtcaaagaggaccaaactaagttcctgaaaattaagacggtgtcctcagaactaagttgcagggagggtcagagctactggacaggctcgttttccccaaaatgtctctctagccgtcggtgccatctggttggggaatgtcacgtgaaccgatgcctttcatggagagataatgagaccagtgcagagttctcctttgtcggagaatctactaccatgagggagaacaagtgtttcgaacagtgcggcggttgggggtgtggctgctttaatgtgaaccccagctgtttgttcgttcacacatatctgcaatccgtgcgcaaggaggcgctccgggtatttaattgcatcgactgggtccataaactgaccttagaaattactgatttcgacggatcagtgagcacaatcgatctgggcgccagttcttccagatttacgaactgggggagcgtgtcgctttcattggacgctgagggaatatctggcagtaattccttcagcttcattgagtctccgggtaaggggtacgccatcgtcgatgaaccttttagcgagattccaaggcagggattcctcggcgaaatccgctgtaactccgagtcaagtgttctgagcgcacacgaatcttgcctacgagctcccaatctgatatcctataaacctatgatcgaccagctcgagtgcaccactaacctgattgatccctttgtggtattcgagcggggttcacttccacagacacgtaatgacaagacctttgccgcaagtaaaggcaacagaggggtgcaagccttcagcaagggatccgtccaggctgacttgacactgatgtttgataacttcgaagtggactttgttggcgcggccgtgtcttgtgatgcagctttcttaaatctcactgggtgctactcgtgtaacgccggagccagggtctgcctgagcatcacctcaacgggcaccggttcccttagtgctcataataaggacgggtctctgcacattgtgttgcctagcgagaacggaacaaaagatcagtgtcaaatcctccattttactgttcccgaagtggaggaggagttcatgtactcctgcgacggcgatgagcgcccactgctagtcaagggtaccctgatagcaattgacccgtttgatgaccggagagaagccggcggggagtcaacagtagtgaatcctaaatctggaagctggaacttcttcgattggtttagtggcctcatgtcctggttcgggggacccctgaagactatccttttgatctgtctgtatgttgcgttaagcattggcctctttttcctgcttatctacctgggtaggaccgggctatctaaaatgtggctcgctgccacgaagaaggcatcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17382 - RNA, 3586 nt, synthetic construct
  misc_feature 1..3586: note = mRNA product Design2 comprising derived and/or modified sequence from RVFV(ZH-548)__DQ380206.1__Gn-Gc (opt3)
  source 1..3586: mol_type = other RNA
ggggcgctgcctacggaggtggcagccatctccttctcggcatcaagcttaccatggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctctcagtgccttcgtggttgtgttcgtattttccagcattgcaatcatctgccttgccattctgtaccgcgtcttgaagtgtctaaaaatagctcctagaaaggtgctgaaccccctcatgtggatcaccgccttcattaggtggatctataaaaagatggttgcacgggtggcggacaatataaaccaagtcaatcgcgaaattggctggatggagggaggccagctggtgcttgggaacccagctcccatccctcgacacgccccaatcccgagatactctacttacctgatgttgctcctgattgtatcatatgcaagtgcctgcagcgaattaatccaggcttcctctaggattacaacctgttcgacggagggagtgaacaccaagtgccggctgagcggtacagccctaatacgtgcaggctccgttggggctgaagcctgtctcatgctgaaaggagtcaaggaggatcagactaaatttcttaagatcaaaaccgtgtcaagtgagttgtcttgccgcgaaggccaaagctactggacaggttccttctcacccaagtgtctgagctctagaaggtgccatctcgtgggggagtgtcacgtcaatcggtgcctgtcctggcgagacaacgaaaccagtgcggagtttagcttcgttggcgaatctactacaatgcgcgagaataaatgctttgagcagtgtggaggctgggggtgcggatgtttcaacgtgaatccttcctgcctttttgtgcatacctatctgcagtcagtaagaaaggaagccttgagggtcttcaactgtattgactgggtgcacaagctcactctggagatcacggattttgacggtagtgttagcacaatcgatttaggcgcttcgtcctctcggttcaccaattgggggagcgtgtcactgagtctagacgcagaaggaatttccggctctaacagcttttccttcatagagtcaccaggtaaagggtacgccatcgtcgatgagcccttcagcgaaattcctcgccagggctttctcggagagatcagatgcaatagtgaatcttccgtgctgagcgctcacgagtcgtgtcttagggccccaaacttgatttcatataagcccatgatcgaccaactggaatgcactaccaatctcatagatccgttcgttgtgtttgagcgtggctctctgcctcagacacggaacgacaaaaccttcgcagcgagtaaggggaatcgaggagtacaggccttttccaaaggcagcgtccaggctgatttaactctgatgttcgacaactttgaggtggatttcgtgggtgccgcagtctcttgtgacgctgcctttcttaatttgacagggtgctacagctgtaacgcaggagccagagtttgcctctccatcacgtcaaccggcactggtagtctgagcgctcataacaaggatggctctctacacattgtgctgccatccgaaaatgggacaaaggaccaatgccagatcctccatttcaccgtacccgaggtggaagaggaatttatgtattcatgtgacggagatgagaggcctctgcttgtcaaaggcacattgattgcgatcgaccccttcgatgaccgccgggaggccgggggagaaagtactgtggttaacccaaagagcggctcctggaactttttcgattggttctctggtctgatgtcgtggtttgggggacctttaaaaaccatactcctgatttgcctttacgtggcactgagcatcggcttgttctttctcctgatttacctaggtagaacgggcctgtcaaagatgtggctcgctgccaccaaaaaggcctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17383 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (opt3)
  source 1..3337: mol_type = other RNA
ggggcgctgcctacggaggtggcagccatctccttctcggcatcaagcttaccatggccggcatcgctatgaccgtgctgcccgcactcgccgtcttcgcgcttgctcctgttgtgtttgccgaggacccacacctgagaaataggccggggaagggacataattacattgatggtatgacacaggaagacgcaacttgcaaacccgtaacgtatgccggcgcttgtagctccttcgatgtgttgttagagaaggggaaatttcctctgttccaatcttacgcacaccatcggaccctactcgaagccgtccacgacacaataatcgctaaggccgatccaccctcatgcgacctgcttagtgcgcatggaaacccttgtatgaaagagaagctggtgatgaagactcactgcccaaatgattatcagagcgcacactacttgaacaatgacggcaaaatggcctccgttaagtgtccccctaaatatgaactcaccgaggattgcaacttttgtcgccagatgacaggtgcttctctgaagaaagggtcgtacccactgcaggacctcttctgccaatcaagcgaggatgacggaagtaagttaaagaccaaaatgaagggcgtgtgtgaagtcggcgtgcaggccctgaaaaagtgcgatgggcagctttccactgcacatgaggtagttccgtttgctgtgttcaaaaattctaagaaagtctatttggacaagctggacctaaagacagaagagaacctcctgcccgatagctttgtgtgtttcgagcacaaaggacagtacaagggtaccatggactccggccaaacgaaacgagaacttaagtcatttgatattagtcagtgccctaaaatcgggggacatggcagcaagaagtgcactggtgacgccgcgttctgttctgcctacgagtgcaccgcacagtatgctaatgcctactgttcccacgctaacgggtcaggaattgtgcagatccaagtcagcggcgtttggaaaaagccactgtgcgtgggctatgaacgtgtagtggtcaaaagagagttgagtgccaagcccatacagagggtggaaccttgtacaacttgcatcaccaaatgtgagccacacgggctcgttgtgcggtctacaggatttaagatttccagcgcagtcgcctgcgcttcgggtgtgtgtgtaaccggctctcagtccccctcaacggagatcactctgaagtacccggggattagtcaaagctccggaggcgatatcggtgttcatatggcgcacgacgatcagtctgtgagctcaaaaatagtcgcacattgccctccccaggacccatgtttagtgcacgattgcattgtctgcgcccatgggctgatcaattatcagtgtcacacagctatggccggcattgcaatgaccgtgctccctgcccttgctgttttcgccctggcacccgtggtattcgcggaagactgcagtgagttgatccaagctagcagccgcatcactacatgttctaccgaaggagtcaacacgaagtgcagactatcaggcaccgccctgattagggcagggagtgtgggagccgaggcttgtctcatgctgaaaggtgttaaggaagatcagacaaaatttcttaagataaagactgtgagctccgagctgtcttgccgggagggccagtcgtactggaccgggagcttctccccaaaatgtttgtcaagtcgccgatgccacctcgtcggagaatgtcatgtgaatagatgcctgtcttggagggacaacgagacaagcgccgaattttccttcgtaggcgagtcaactaccatgcgggaaaataagtgttttgagcagtgcggtgggtggggctgcggatgtttcaacgtgaaccccagctgcttatttgttcacacatatctgcaatctgtccgtaaagaggcactacgcgtgttcaattgtatcgactgggtgcataagctcaccctggaaattactgattttgacggctccgtcagtacgatcgatcttggggcttcctcttccagattcacaaactggggatcagttagtttgagcctggacgccgagggtatatcgggctccaattcttttagcttcattgaatcacctgggaaaggatacgcgatcgtggatgagccatttagtgagatcccgaggcagggcttcctcggtgaaattcggtgcaactccgagtctagcgtgctgtccgcccacgaatcatgtcttcgagctcccaatctgatcagctacaagcctatgattgaccagttggagtgcaccactaacctcatagatccattcgtagtctttgaacgcgggagtctgccccagaccagaaatgacaaaacattcgcagcctctaagggcaacaggggagtgcaggctttttccaagggcagcgttcaagccgatttaaccctgatgttcgacaattttgaggtggatttcgtcggggcagcggtgtcgtgtgacgccgcttttctaaacctcactggatgctattcatgtaatgccggcgcacgggtttgcctgtctatcacaagtacgggtaccgggtcccttagcgctcacaacaaagatggatctttgcatattgtgctgcctagcgagaatggcactaaggaccagtgtcagatcctccacttcacagtaccagaagtcgaggaagagtttatgtactcctgcgacggtgatgaacgccccctgttagtgaaaggcaccctgatcgccattgacccgttcgatgacagaagggaggcagggggagagtcaacagtggtcaaccctaagagtggcagctggaactttttcgattggttttctgggcttatgtcctggttcggaggcccattgaaaactatactcctgatctgcctatatgttgccctgtcaattggtctcttctttctgcttatctacttggggcgtaccggactgagtaagatgtggttagctgcgacgaagaaagccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17384 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (opt3)
  source 1..3571: mol_type = other RNA
ggggcgctgcctacggaggtggcagccatctccttctcggcatcaagcttaccatggactggacatggatcctgttcctcgtggccgctgcaacaagagtccacagcgaggatccccatcttaggaaccggcctggcaaggggcacaattacattgacggaatgactcaggaagatgccacgtgcaaaccagttacctatgcgggtgcttgttcctcttttgacgtgctgttggagaagggcaaattcccgttatttcaatcatacgcccatcaccgcacactgctagaagcagtacatgatactataatcgccaaggctgatccccctagttgcgacctcctgagcgcacacgggaacccatgtatgaaagagaaacttgtgatgaagacccactgccccaatgactatcagtccgcccattacctgaacaatgatggaaaaatggcttctgtcaagtgtcctccaaaatatgaattgacagaggactgcaacttctgtcgacagatgaccggcgcctcgctcaagaaaggttcataccccctgcaggatctgttttgccaaagcagtgaggacgatgggtccaagctcaagactaaaatgaagggagtgtgtgaagttggcgtgcaggcgttaaagaagtgcgacggccagctgtctacagcacacgaggtcgtgcctttcgccgtatttaaaaatagcaagaaagtttatcttgacaagttggatctgaagaccgaagagaacctactcccagactccttcgtgtgttttgagcataaagggcagtacaagggaacgatggattcaggtcaaactaaacgtgaactgaagagtttcgacattagccagtgcccgaaaatcggcgggcacggatctaagaagtgcaccggcgatgctgccttttgttccgcatacgagtgcacagctcagtatgccaatgcgtactgttcacacgccaacggtagcgggattgtccagatccaagtgagtggagtgtggaaaaagcccctttgcgtcggctatgaaagagttgtggtaaaaagggagctgtctgcaaagcctatacagcgggtggaaccatgtactacctgcatcacaaaatgtgagccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagacatcggcgtgcacatggcccatgatgaccagagcgtatcaagtaaaatagttgcacactgtcccccgcaggatccttgcctggtgcatgactgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgataatataaaccaagttaatcgagaaattgggtggatggagggcggacagctcgtgctgggcaaccctgctcccatcccaagacatgcccccatccctaggtactcaacataccttatgctgttgctcattgtcagttatgcaagcgcgtgctccgaactgatccaggcttcttcgcggattaccacgtgtagcaccgagggggtgaacacaaagtgccgtttatccggaactgccctgatacgcgcaggttcagtaggcgccgaggcttgtctaatgctcaaaggggtgaaggaagaccagaccaaattcctgaagatcaaaacagttagttctgagcttagctgcagagaaggacaatcctactggactggctcatttagcccaaagtgtttgtcttccaggcggtgccacctggtcggtgagtgtcatgtgaatcgatgcctcagttggcgcgacaacgaaaccagcgccgagttctcttttgtgggggaatccacaaccatgagagagaataaatgcttcgagcagtgtggcggatggggctgcgggtgttttaacgtcaatccgtcatgcctgttcgttcacacttatcttcagagtgtgaggaaggaagcactgcgggtgtttaactgtattgattgggtacacaagttgacgctcgagatcacagacttcgatggaagcgtctcgaccatcgacctgggtgcttcctctagccgctttactaattggggctcagtgagtttatccctggatgccgaagggatttctggaagcaactccttctcatttatagagagccccggcaaaggttacgcgatcgttgacgagcctttcagtgaaattccaagacaggggttcctaggcgagatcaggtgcaattctgaatccagcgtgctctcggcccatgagtcatgtctgcgtgctcccaaccttatttcttataagcctatgatcgatcaattggaatgcaccacaaatctgatagacccatttgtcgtgttcgagcggggaagtctcccccagacccgaaacgataaaacttttgcagcctccaagggcaatagaggggttcaggctttcagcaaaggatctgtgcaggccgacctgacattaatgtttgataacttcgaggtagactttgtcggcgcagcggtgagctgtgatgccgctttcctgaatcttacgggttgctactcctgtaacgccggggcaagggtgtgcttgtcaatcaccagtactggaacaggcagcctctctgctcacaacaaggacggttccctgcatattgtcctaccgtcagaaaatggcaccaaggaccaatgccagatcctgcactttacagttcctgaggtggaagaggagttcatgtatagttgtgatggggacgaacgcccactcctggtaaaaggaactcttattgccatcgatccctttgacgatcggagagaggcaggcggggaaagcaccgtggtcaaccctaagtccggatcttggaatttctttgactggttctcgggcttgatgagctggttcggtgggcccctgaaaacgatattactcatttgcctgtacgtggccctttcaatcggactgtttttcttgctcatttacctgggcaggaccggtctatccaagatgtggctggctgcgaccaaaaaggccagttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17385 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (opt3)
  source 1..3565: mol_type = other RNA
ggggcgctgcctacggaggtggcagccatctccttctcggcatcaagcttaccatggactggacatggatcctgttcctcgtggccgctgcaacaagagtccacagcccccatcttaggaaccggcctggcaaggggcacaattacattgatggaatgactcaggaggacgccacgtgcaaaccagttacctatgcgggtgcttgttcctcttttgatgtgctgttggaaaagggcaaattcccgttatttcaatcatacgcccatcaccgcacactgctagaggcagtacatgacactataatcgccaaggctgatccccctagttgcgacctcctgagcgcacacgggaacccatgtatgaaagaaaaacttgtgatgaagacccactgccccaatgattatcagtccgcccattacctgaacaatgacggaaaaatggcttctgtcaagtgtcctccaaaatatgagttgacagaagattgcaacttctgtcgacagatgaccggcgcctcgctcaagaaaggttcataccccctgcaggacctgttttgccaaagcagtgaggatgacgggtccaagctcaagactaaaatgaagggagtgtgtgaggttggcgtgcaggcgttaaagaagtgcgatggccagctgtctacagcacacgaagtcgtgcctttcgccgtatttaaaaatagcaagaaagtttatcttgacaagttggacctgaagaccgaggaaaacctactcccagattccttcgtgtgttttgagcataaagggcagtacaagggaacgatggactcaggtcaaactaaacgtgagctgaagagtttcgatattagccagtgcccgaaaatcggcgggcacggatctaagaagtgcaccggcgacgctgccttttgttccgcatacgaatgcacagctcagtatgccaatgcgtactgttcacacgccaacggtagcgggattgtccagatccaagtgagtggagtgtggaaaaagcccctttgcgtcggctatgagagagttgtggtaaaaagggaactgtctgcaaagcctatacagcgggtggagccatgtactacctgcatcacaaaatgtgaaccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagatatcggcgtgcacatggcccatgacgatcagagcgtatcaagtaaaatagttgcacactgtcccccgcaggacccttgcctggtgcatgattgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgacaatataaaccaagttaatcgagagattgggtggatggaaggcggacagctcgtgctgggcaaccctgctcccatcccaagacatgcccccatccctaggtactcaacataccttatgctgttgctcattgtcagttatgcaagcgcgtgctccgagctgatccaggcttcttcgcggattaccacgtgtagcaccgaaggggtgaacacaaagtgccgtttatccggaactgccctgatacgcgcaggttcagtaggcgccgaggcttgtctaatgctcaaaggggtgaaggaagatcagaccaaattcctgaagatcaaaacagttagttctgagcttagctgcagagagggacaatcctactggactggctcatttagcccaaagtgtttgtcttccaggcggtgccacctggtcggtgaatgtcatgtgaatcgatgcctcagttggcgcgacaacgagaccagcgccgagttctcttttgtgggggaatccacaaccatgagagaaaataaatgcttcgagcagtgtggcggatggggctgcgggtgttttaacgtcaatccgtcatgcctgttcgttcacacttatcttcagagtgtgaggaaggaggcactgcgggtgtttaactgtattgactgggtacacaagttgacgctcgaaatcacagatttcgacggaagcgtctcgaccatcgatctgggtgcttcctctagccgctttactaattggggctcagtgagtttatccctggacgccgaggggatttctggaagcaactccttctcatttatagaaagccccggcaaaggttacgcgatcgttgatgagcctttcagtgagattccaagacaggggttcctaggcgaaatcaggtgcaattctgagtccagcgtgctctcggcccatgaatcatgtctgcgtgctcccaaccttatttcttataagcctatgatcgaccaattggagtgcaccacaaatctgatagatccatttgtcgtgttcgaacggggaagtctcccccagacccgaaacgacaaaacttttgcagcctccaagggcaatagaggggttcaggctttcagcaaaggatctgtgcaggccgatctgacattaatgtttgacaacttcgaggtagattttgtcggcgcagcggtgagctgtgacgccgctttcctgaatcttacgggttgctactcctgtaacgccggggcaagggtgtgcttgtcaatcaccagtactggaacaggcagcctctctgctcacaacaaggatggttccctgcatattgtcctaccgtcagagaatggcaccaaggaccaatgccagatcctgcactttacagttcctgaagtggaggaagagttcatgtatagttgtgacggggatgaacgcccactcctggtaaaaggaactcttattgccatcgacccctttgatgaccggagagaggcaggcggggagagcaccgtggtcaaccctaagtccggatcttggaatttctttgattggttctcgggcttgatgagctggttcggtgggcccctgaaaacgatattactcatttgcctgtacgtggccctttcaatcggactgtttttcttgctcatttacctgggcaggaccggtctatccaagatgtggctggctgcgaccaaaaaggccagttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17386 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (opt3)
  source 1..2050: mol_type = other RNA
ggggcgctgcctacggaggtggcagccatctccttctcggcatcaagcttaccatggactggacctggatcctgttcctcgtggccgctgcaacaagagtccacagcgaggatccccatcttaggaaccggcctggcaaggggcacaattacattgacggaatgactcaggaagatgccacgtgcaaaccagttacctatgcgggtgcttgttcctcttttgacgtgctgttggagaagggcaaattcccgttatttcaatcatacgcccatcaccgcacactgctagaagcagtacatgatactataatcgccaaggctgatccccctagttgcgacctcctgagcgcacacgggaacccatgtatgaaagagaaacttgtgatgaagacccactgccccaatgactatcagtccgcccattacctgaacaatgatggaaaaatggcttctgtcaagtgtcctccaaaatatgaattgacagaggactgcaacttctgtcgacagatgaccggcgcctcgctcaagaaaggttcataccccctgcaggatctgttttgccaaagcagtgaggacgatgggtccaagctcaagactaaaatgaagggagtgtgtgaagttggcgtgcaggcgttaaagaagtgcgacggccagctgtctacagcacacgaggtcgtgcctttcgccgtatttaaaaatagcaagaaagtttatcttgacaagttggatctgaagaccgaagagaacctactcccagactccttcgtgtgttttgagcataaagggcagtacaagggaacgatggattcaggtcaaactaaacgtgaactgaagagtttcgacattagccagtgcccgaaaatcggcgggcacggatctaagaagtgcaccggcgatgctgccttttgttccgcatacgagtgcacagctcagtatgccaatgcgtactgttcacacgccaacggtagcgggattgtccagatccaagtgagtggagtgtggaaaaagcccctttgcgtcggctatgaaagagttgtggtaaaaagggagctgtctgcaaagcctatacagcgggtggaaccatgtactacctgcatcacaaaatgtgagccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagacatcggcgtgcacatggcccatgatgaccagagcgtatcaagtaaaatagttgcacactgtcccccgcaggatccttgcctggtgcatgactgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgataatataaaccaagttaatcgagaaattgggtggatggagggcggacagctcgtgctgggcaaccctgctcccatcccaagacatgcccccatccctaggtactcaacataccttatgctgttgctcattgtcagttatgcaagcgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17387 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (opt3)
  source 1..2044: mol_type = other RNA
ggggcgctgcctacggaggtggcagccatctccttctcggcatcaagcttaccatggactggacctggatcctgttcctcgtggccgctgcaacaagagtccacagcccccatcttaggaaccggcctggcaaggggcacaattacattgatggaatgactcaggaggacgccacgtgcaaaccagttacctatgcgggtgcttgttcctcttttgatgtgctgttggaaaagggcaaattcccgttatttcaatcatacgcccatcaccgcacactgctagaggcagtacatgacactataatcgccaaggctgatccccctagttgcgacctcctgagcgcacacgggaacccatgtatgaaagaaaaacttgtgatgaagacccactgccccaatgattatcagtccgcccattacctgaacaatgacggaaaaatggcttctgtcaagtgtcctccaaaatatgagttgacagaagattgcaacttctgtcgacagatgaccggcgcctcgctcaagaaaggttcataccccctgcaggacctgttttgccaaagcagtgaggatgacgggtccaagctcaagactaaaatgaagggagtgtgtgaggttggcgtgcaggcgttaaagaagtgcgatggccagctgtctacagcacacgaagtcgtgcctttcgccgtatttaaaaatagcaagaaagtttatcttgacaagttggacctgaagaccgaggaaaacctactcccagattccttcgtgtgttttgagcataaagggcagtacaagggaacgatggactcaggtcaaactaaacgtgagctgaagagtttcgatattagccagtgcccgaaaatcggcgggcacggatctaagaagtgcaccggcgacgctgccttttgttccgcatacgaatgcacagctcagtatgccaatgcgtactgttcacacgccaacggtagcgggattgtccagatccaagtgagtggagtgtggaaaaagcccctttgcgtcggctatgagagagttgtggtaaaaagggaactgtctgcaaagcctatacagcgggtggagccatgtactacctgcatcacaaaatgtgaaccccatggcttggtcgtgcgctccaccgggttcaagattagctcggctgttgcctgcgcttctggagtgtgtgtcacgggttcccagtcacctagtactgagatcacactcaagtacccaggcattagccaatcctctgggggagatatcggcgtgcacatggcccatgacgatcagagcgtatcaagtaaaatagttgcacactgtcccccgcaggacccttgcctggtgcatgattgcattgtctgcgcccacggtttaatcaattatcagtgtcacaccgctctgtccgcgtttgtggtcgtgttcgttttcagctctattgcaatcatctgcctcgccattctttacagagtgctgaagtgtttgaaaatagctcccaggaaggtactaaacccactgatgtggatcactgcctttattcggtggatctataaaaagatggtcgcacgcgtggccgacaatataaaccaagttaatcgagagattgggtggatggaaggcggacagctcgtgctgggcaaccctgctcccatcccaagacatgcccccatccctaggtactcaacataccttatgctgttgctcattgtcagttatgcaagcgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17388 - RNA, 1960 nt, synthetic construct
  misc_feature 1..1960: note = mRNA product Design2 comprising derived and/or modified sequence from RVFV(ZH-548)__DQ380206.1__IgE-leader_Gc (opt3)
  source 1..1960: mol_type = other RNA
ggggcgctgcctacggaggtggcagccatctccttctcggcatcaagcttaccatggactggacctggatcctgttcctcgtggccgctgcaacaagagtccacagctgctccgagcttattcaggcctcttcaaggataactacgtgtagtaccgaaggcgttaatacaaagtgccggctgagcgggactgcgttgatccgcgctggatccgtgggtgccgaggcatgtttaatgctgaaaggcgtaaaggaagatcaaaccaaatttctaaagattaaaacagtgtcttcggagctctcatgccgagaagggcagagctactggaccggaagtttctcccccaagtgtctgtctagccgtagatgccatcttgtcggcgagtgtcacgtgaataggtgcctgtcctggcgggacaacgagacttcagccgaatttagtttcgttggtgagagcacaaccatgcgcgaaaataagtgttttgagcagtgcgggggatggggctgtggctgcttcaacgtgaatccttcttgcttgtttgtccatacgtatctccagtccgtgagaaaagaggctctgagggtattcaactgtatcgattgggttcacaagctgactctcgaaattaccgactttgatgggtcagtgagcacaatcgacttaggagcaagttcttcccggttcactaattggggtagcgtctcgctgtctcttgatgccgagggcatatccgggtcaaacagttttagcttcatcgaatccccaggaaaaggctacgctattgtggacgagccgttttctgaaatcccccgccaaggtttcttgggggagattcgatgcaatagcgagtcaagtgtgctgtccgcccatgaaagctgtctaagagcgcctaacctcatctcttataagccaatgatagatcagctggagtgcaccacaaatcttattgaccccttcgtcgtttttgaaaggggatcactgcctcagacccggaacgataaaacgttcgcagccagtaagggcaatcgtggcgtgcaggcttttagcaaggggtccgtacaagccgacttgactctcatgttcgataactttgaggtggacttcgtcggagcagctgtgtcttgtgacgccgcgtttctgaatttaacaggttgctactcgtgtaacgccggcgcacgcgtttgcctgagcatcacctccactgggacaggatcactcagtgctcacaacaaagatggctctcttcacattgtgctgccaagcgaaaatggtaccaaggaccagtgtcagatcttgcatttcacggtccccgaggtggaggaagagtttatgtattcctgcgatggggacgaaagacctctactggtaaaaggcaccctcatcgccattgatccattcgacgataggcgggaggctggaggcgaatcaacagttgtgaacccgaaaagcgggtcttggaactttttcgactggttttccggactgatgagttggttcggtggcccccttaaaactatactgttgatctgtctctacgtcgccctgagcattgggttattctttctgctaatctatctcggacgaaccggcctgtctaagatgtggcttgcagccacaaagaaggcttcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17389 - RNA, 1120 nt, synthetic construct
  misc_feature 1..1120: note = mRNA product Design2 comprising derived and/or modified sequence from RVFV(ZH-548)__DQ380151.1__N (opt1)
  source 1..1120: mol_type = other RNA
ggggcgctgcctacggaggtggcagccatctccttctcggcatcaagcttaccatggacaactaccaggagctggccatccagttcgccgcgcaggccgtggaccgcaacgagatcgagcagtgggtccgggagttcgcctaccagggcttcgacgcccgccgggtgatcgagctcctgaagcagtacgggggcgccgactgggagaaggacgcgaagaagatgatcgtgctggccctcacccgcgggaacaagccccggcgcatgatgatgaagatgagcaaggagggcaaggccaccgtcgaggccctgatcaacaagtacaagctgaaggaggggaacccgtcccgggacgagctcacgctgagccgcgtggcggccgccctggccggctggacctgccaggccctcgtggtcctgtccgagtggctgcccgtgaccggcaccacgatggacgggctcagccccgcgtacccccggcacatgatgcacccgtccttcgccggcatggtggaccccagcctgcccggggactacctgcgcgccatcctcgacgcccactccctgtacctgctccagttcagccgggtcatcaaccccaacctgcgcggccggaccaaggaggaggtggccgcgaccttcacccagccgatgaacgccgccgtgaactccaacttcatcagccacgagaagcgccgggagttcctgaaggccttcgggctcgtcgactccaacggcaagcccagcgccgcggtgatggccgccgcccaggcctacaagacggcggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17390 - RNA, 3976 nt, synthetic construct
  misc_feature 1..3976: note = mRNA product Design2 comprising derived and/or modified sequence from RVFV(ZH-548)__DQ380206.1__GP (opt1) R6110
  source 1..3976: mol_type = other RNA
ggggcgctgcctacggaggtggcagccatctccttctcggcatcaagcttaccatgtacgtgctgctcaccatcctgatcagcgtcctggtgtgcgaggccgtgatccgcgtctccctcagctccacccgggaggagacgtgcttcggcgacagcaccaaccccgagatgatcgagggggcctgggactccctgcgcgaggaggagatgccggaggagctgagctgctccatcagcggcatccgggaggtgaagacctccagccaggagctctaccgcgcgctgaaggccatcatcgccgccgacgggctgaacaacatcacgtgccacggcaaggaccccgaggacaagatctccctcatcaaggggccgccccacaagaagcgggtgggcatcgtccgctgcgagcggcgccgggacgccaagcagatcggccgcgagaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17391 - RNA, 3586 nt, synthetic construct
  misc_feature 1..3586: note = mRNA product Design2 comprising derived and/or modified sequence from RVFV(ZH-548)__DQ380206.1__Gn-Gc (opt1) R6111
  source 1..3586: mol_type = other RNA
ggggcgctgcctacggaggtggcagccatctccttctcggcatcaagcttaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17392 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (opt1) R6115
  source 1..3337: mol_type = other RNA
ggggcgctgcctacggaggtggcagccatctccttctcggcatcaagcttaccatggcggggatcgccatgaccgtgctgcccgccctggccgtgttcgcgctcgcccccgtcgtgttcgccgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccatggcggggatcgccatgaccgtgctgcccgccctggccgtgttcgcgctcgcccccgtcgtgttcgccgaggactgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17393 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (opt1) R6164
  source 1..3571: mol_type = other RNA
ggggcgctgcctacggaggtggcagccatctccttctcggcatcaagcttaccatggactggacctggatcctgttcctcgtggccgccgcgacccgcgtccacagcgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17394 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (opt1) R6112
  source 1..3565: mol_type = other RNA
ggggcgctgcctacggaggtggcagccatctccttctcggcatcaagcttaccatggactggacctggatcctgttcctcgtggccgccgcgacccgcgtccacagcccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17395 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (opt1) R6165
  source 1..2050: mol_type = other RNA
ggggcgctgcctacggaggtggcagccatctccttctcggcatcaagcttaccatggactggacctggatcctgttcctcgtggccgccgcgacccgcgtccacagcgaggacccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17396 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (opt1) R6113
  source 1..2044: mol_type = other RNA
ggggcgctgcctacggaggtggcagccatctccttctcggcatcaagcttaccatggactggacctggatcctgttcctcgtggccgccgcgacccgcgtccacagcccccacctccggaaccgccccggcaaggggcacaactacatcgacggcatgacccaggaggacgcgacctgcaagccggtgacgtacgccggggcgtgcagctccttcgacgtcctgctggagaagggcaagttccccctgttccagagctacgcccaccaccggaccctgctcgaggccgtgcacgacaccatcatcgccaaggccgacccgccctcctgcgacctgctgagcgcgcacggcaacccctgcatgaaggagaagctcgtgatgaagacccactgccccaacgactaccagtccgcccactacctgaacaacgacgggaagatggccagcgtcaagtgcccgcccaagtacgagctgacggaggactgcaacttctgccgccagatgaccggcgcctccctcaagaaggggagctaccccctgcaggacctgttctgccagagctccgaggacgacggcagcaagctcaagaccaagatgaagggcgtgtgcgaggtgggggtccaggccctgaagaagtgcgacggccagctgtccaccgcgcacgaggtggtgcccttcgccgtcttcaagaacagcaagaaggtgtacctcgacaagctggacctgaagacggaggagaacctcctgcccgactccttcgtgtgcttcgagcacaaggggcagtacaagggcaccatggacagcgggcagaccaagcgggagctgaagtccttcgacatcagccagtgccccaagatcggcggccacgggtccaagaagtgcaccggcgacgccgccttctgcagcgcctacgagtgcacggcgcagtacgccaacgcctactgctcccacgccaacgggagcggcatcgtccagatccaggtgtccggggtctggaagaagccgctctgcgtgggctacgagcgcgtggtcgtgaagcgggagctgagcgcgaagcccatccagcgcgtggagccctgcacgacctgcatcaccaagtgcgagccccacggcctggtcgtgcggtccaccgggttcaagatcagctccgccgtggcctgcgccagcggcgtctgcgtgaccgggtcccagagcccgagcaccgagatcaccctcaagtaccccggcatctcccagagctccgggggcgacatcggcgtgcacatggcccacgacgaccagagcgtctccagcaagatcgtggcgcactgcccgccccaggacccctgcctggtgcacgactgcatcgtctgcgcccacgggctgatcaactaccagtgccacacggccctctccgccttcgtggtggtcttcgtgttcagctccatcgccatcatctgcctggcgatcctgtaccgcgtgctcaagtgcctgaagatcgcgccccggaaggtcctgaaccccctcatgtggatcaccgccttcatccgctggatctacaagaagatggtggcccgcgtggccgacaacatcaaccaggtcaaccgggagatcggctggatggagggcgggcagctggtgctgggcaacccggcccccatcccccgccacgcccccatcccgcggtacagcacctacctgatgctcctgctgatcgtgtcctacgccagcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17397 - RNA, 1960 nt, synthetic construct
  misc_feature 1..1960: note = mRNA product Design2 comprising derived and/or modified sequence from RVFV(ZH-548)__DQ380206.1__IgE-leader_Gc (opt1) R6114
  source 1..1960: mol_type = other RNA
ggggcgctgcctacggaggtggcagccatctccttctcggcatcaagcttaccatggactggacctggatcctgttcctcgtggccgccgcgacccgcgtccacagctgctccgagctcatccaggcgagctcccgcatcaccacgtgcagcaccgagggggtcaacaccaagtgccggctgtccggcaccgccctgatccgcgccgggagcgtgggcgccgaggcctgcctcatgctgaagggggtgaaggaggaccagacgaagttcctgaagatcaagaccgtcagctccgagctcagctgccgggagggccagtcctactggaccggcagcttctcccccaagtgcctgagctcccgccggtgccacctggtgggggagtgccacgtgaaccgctgcctcagctggcgggacaacgagacctccgcggagttcagcttcgtcggcgagtccaccacgatgcgcgagaacaagtgcttcgagcagtgcgggggctgggggtgcggctgcttcaacgtgaaccccagctgcctgttcgtgcacacctacctgcagtccgtccggaaggaggccctccgcgtgttcaactgcatcgactgggtgcacaagctgaccctggagatcaccgacttcgacggcagcgtctccacgatcgacctcggggccagctccagccggttcaccaactggggctccgtgagcctgagcctggacgccgaggggatctccggcagcaactccttcagcttcatcgagtcccccgggaagggctacgccatcgtggacgagccgttcagcgagatcccccgccagggcttcctcggggagatccggtgcaactccgagagctccgtcctgagcgcgcacgagtcctgcctgcgcgcccccaacctcatcagctacaagcccatgatcgaccagctggagtgcaccaccaacctgatcgacccgttcgtggtgttcgagcggggctccctcccccagacgcgcaacgacaagaccttcgccgccagcaaggggaaccgcggcgtccaggccttctccaaggggagcgtgcaggcggacctgaccctgatgttcgacaacttcgaggtggacttcgtcggcgccgccgtgtcctgcgacgccgcgttcctcaacctgaccggctgctacagctgcaacgccggggcccgggtgtgcctgtccatcacgagcaccggcaccgggagcctctccgcccacaacaaggacggcagcctgcacatcgtcctgccctccgagaacggcaccaaggaccagtgccagatcctccacttcacggtgcccgaggtcgaggaggagttcatgtacagctgcgacggggacgagcgcccgctgctggtgaagggcaccctcatcgccatcgaccccttcgacgaccggcgcgaggccgggggcgagtccaccgtggtcaaccccaagagcgggtcctggaacttcttcgactggttcagcggcctgatgtcctggttcggcgggcccctgaagaccatcctcctgatctgcctgtacgtggccctcagcatcggcctgttcttcctgctcatctacctggggcggacgggcctgtccaagatgtggctcgccgccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17398 - RNA, 1120 nt, synthetic construct; identical to SEQ ID NO: 17389
  misc_feature 1..1120: note = mRNA product Design2 comprising derived and/or modified sequence from RVFV(ZH-548)__DQ380151.1__N (opt1)
  source 1..1120: mol_type = other RNA

SEQ ID NO: 17399 - RNA, 3976 nt, synthetic construct; identical to SEQ ID NO: 17390
  misc_feature 1..3976: note = mRNA product Design2 comprising derived and/or modified sequence from RVFV(ZH-548)__DQ380206.1__GP (opt1)
  source 1..3976: mol_type = other RNA

SEQ ID NO: 17400 - RNA, 3586 nt, synthetic construct
  misc_feature 1..3586: note = mRNA product Design2 comprising derived and/or modified sequence from RVFV(ZH-548)__DQ380206.1__Gn-Gc (opt1)
  source 1..3586: mol_type = other RNA
ggggcgctgcctacggaggtggcagccatctccttctcggcatcaagcttaccatggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgctgagcgccttcgtggtcgtgttcgtgttctccagcatcgccatcatctgcctggccatcctctaccgggtcctgaagtgcctgaagatcgcgccccgcaaggtgctcaaccccctgatgtggatcaccgccttcatccggtggatctacaagaagatggtggcccgcgtcgccgacaacatcaaccaggtgaaccgggagatcgggtggatggagggcgggcagctggtgctcggcaaccccgcccccatcccgcgccacgcccccatcccccggtactccacctacctgatgctgctcctgatcgtcagctacgcgagcgcctgctccgagctgatccaggccagctcccgcatcacgacctgcagcaccgagggggtgaacaccaagtgccggctctccggcacggccctgatccgcgccggcagcgtgggggcggaggcctgcctgatgctcaagggcgtcaaggaggaccagaccaagttcctgaagatcaagaccgtgtccagcgagctgtcctgccgggaggggcagagctactggaccggctccttcagcccgaagtgcctgtccagccgccggtgccacctcgtgggcgagtgccacgtcaaccgctgcctgtcctggcgcgacaacgagacgagcgccgagttctccttcgtgggggagagcaccaccatgcgggagaacaagtgcttcgagcagtgcggcgggtggggctgcgggtgcttcaacgtgaaccccagctgcctgttcgtccacacctacctccagtccgtgcgcaaggaggccctgcgggtgttcaactgcatcgactgggtccacaagctgacgctcgagatcaccgacttcgacggcagcgtgtccaccatcgacctgggcgcgagctccagccgcttcaccaactgggggtccgtgagcctgtccctcgacgccgagggcatcagcgggtccaacagcttctccttcatcgagagccccggcaaggggtacgccatcgtcgacgagcccttctccgagatcccgcggcagggcttcctgggcgagatccgctgcaacagcgagtccagcgtgctgtccgcccacgagagctgcctccgggcccccaacctgatcagctacaagcccatgatcgaccagctggagtgcaccacgaacctcatcgaccccttcgtggtcttcgagcgcgggtccctgccgcagacccggaacgacaagaccttcgcggccagcaagggcaaccgcggggtgcaggccttctccaagggcagcgtgcaggccgacctgaccctcatgttcgacaacttcgaggtcgacttcgtgggggccgcggtgtcctgcgacgccgccttcctgaacctgacgggctgctacagctgcaacgccggcgcccgggtctgcctctccatcaccagcaccgggaccggctccctgagcgcgcacaacaaggacgggtccctgcacatcgtgctccccagcgagaacggcacgaaggaccagtgccagatcctgcacttcaccgtgcccgaggtcgaggaggagttcatgtactcctgcgacggggacgagcgccccctgctcgtgaagggcaccctgatcgccatcgacccgttcgacgaccggcgcgaggccggcggggagagcaccgtggtcaaccccaagtccggcagctggaacttcttcgactggttctccgggctgatgagctggttcggcggccccctcaagacgatcctgctgatctgcctctacgtggccctgtccatcgggctgttcttcctcctgatctacctgggccggaccgggctcagcaagatgtggctggcggccaccaagaaggccagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17401 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (opt1)
  source 1..3337: mol_type = other RNA
ggggcgctgcctacggaggtggcagccatctccttctcggcatcaagcttaccatggccggcatcgccatgaccgtgctgcccgcgctcgccgtcttcgccctggccccggtggtgttcgccgaggacccccacctccgcaaccggcccgggaagggccacaactacatcgacgggatgacccaggaggacgcgacgtgcaagcccgtcacctacgccggcgcctgcagctccttcgacgtgctgctggagaaggggaagttcccgctgttccagagctacgcccaccaccgcaccctcctggaggcggtgcacgacaccatcatcgccaaggccgacccgccctcctgcgacctgctcagcgcccacggcaacccctgcatgaaggagaagctggtcatgaagacgcactgccccaacgactaccagtccgcccactacctgaacaacgacggcaagatggcgagcgtgaagtgcccgcccaagtacgagctcaccgaggactgcaacttctgccggcagatgaccggggcctccctgaagaagggcagctaccccctgcaggacctcttctgccagtccagcgaggacgacgggtccaagctgaagaccaagatgaagggcgtgtgcgaggtcggggtgcaggccctgaagaagtgcgacggccagctcagcacggcccacgaggtggtccccttcgccgtgttcaagaactccaagaaggtgtacctggacaagctggacctcaagaccgaggagaacctgctgcccgacagcttcgtctgcttcgagcacaagggccagtacaaggggaccatggactccggccagaccaagcgcgagctcaagagcttcgacatctcccagtgccccaagatcgggggccacggcagcaagaagtgcacgggggacgcggccttctgctccgcctacgagtgcaccgcccagtacgccaacgcgtactgcagccacgccaacggcagcgggatcgtgcagatccaggtgtccggcgtctggaagaagcccctgtgcgtggggtacgagcgggtggtcgtgaagcgcgagctgagcgccaagccgatccagcgggtggagccctgcacgacctgcatcaccaagtgcgagccccacggcctcgtcgtgcgctccaccggcttcaagatcagctccgccgtcgcctgcgcgagcggggtgtgcgtgaccggctcccagagcccctccaccgagatcacgctgaagtacccggggatcagccagtccagcggcggggacatcggcgtccacatggcccacgacgaccagtccgtgagctccaagatcgtggcccactgcccgccccaggacccctgcctggtccacgactgcatcgtgtgcgcccacggcctcatcaactaccagtgccacaccgcgatggccgggatcgccatgaccgtgctgcccgccctggccgtcttcgcgctcgcccccgtggtgttcgccgaggactgcagcgagctgatccaggcctccagccggatcaccacgtgctccaccgagggcgtcaacaccaagtgccgcctgagcgggaccgccctcatccgggcgggcagcgtgggggccgaggcctgcctgatgctgaagggcgtgaaggaggaccagacgaagttcctcaagatcaagaccgtctccagcgagctgtcctgccgcgagggccagagctactggaccgggtccttcagccccaagtgcctgtccagccggcgctgccacctcgtgggcgagtgccacgtgaaccggtgcctgtcctggcgcgacaacgagaccagcgccgagttctccttcgtcggggagagcacgaccatgcgggagaacaagtgcttcgagcagtgcggcggctgggggtgcggctgcttcaacgtgaacccctcctgcctgttcgtgcacacctacctccagagcgtccgcaaggaggccctgcgggtgttcaactgcatcgactgggtgcacaagctgaccctcgagatcacggacttcgacgggtccgtcagcaccatcgacctgggcgcgtccagcagccgcttcaccaactgggggtccgtgagcctgtccctggacgccgagggcatcagcggctccaacagcttctccttcatcgagagcccggggaagggctacgccatcgtggacgagcccttctccgagatcccccggcaggggttcctcggcgagatccgctgcaacagcgagtccagcgtcctgtccgcccacgagagctgcctgcgcgcgccgaacctcatctcctacaagcccatgatcgaccagctggagtgcaccaccaacctgatcgaccccttcgtggtgttcgagcgggggagcctcccccagacgcgcaacgacaagaccttcgccgcctccaagggcaaccggggcgtccaggccttcagcaaggggtccgtgcaggccgacctgaccctgatgttcgacaacttcgaggtggacttcgtcggcgcggccgtgagctgcgacgccgccttcctcaacctgaccgggtgctacagctgcaacgccggcgcgcgcgtgtgcctgtccatcacgagcaccgggaccggctccctcagcgcccacaacaaggacggctccctgcacatcgtcctgccgagcgagaacgggaccaaggaccagtgccagatcctccacttcacggtgcccgaggtggaggaggagttcatgtactcctgcgacggcgacgagcggcccctgctggtcaaggggaccctcatcgccatcgaccccttcgacgaccgccgggaggccggcggggagagcaccgtggtgaacccgaagtccggcagctggaacttcttcgactggttctccggcctgatgagctggttcgggggccccctgaagaccatcctcctgatctgcctgtacgtcgccctctccatcgggctgttcttcctgctcatctacctgggccgcacgggcctgagcaagatgtggctcgcggccaccaagaaggcctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17402 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (opt1)
  source 1..3571: mol_type = other RNA
ggggcgctgcctacggaggtggcagccatctccttctcggcatcaagcttaccatggactggacctggatcctgttcctcgtggccgccgcgacccgcgtccacagcgaggacccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgcagcgagctgatccaggcctccagccggatcacgacctgctccaccgagggcgtgaacaccaagtgccgcctgagcgggaccgccctcatccgggcgggctccgtcggcgccgaggcctgcctgatgctgaagggggtgaaggaggaccagaccaagttcctcaagatcaagaccgtgagctccgagctgagctgccgcgagggccagtcctactggacggggagcttctcccccaagtgcctgagctcccggcgctgccacctggtcggcgagtgccacgtgaaccgctgcctcagctggcgggacaacgagacctccgccgagttcagcttcgtgggcgagagcaccaccatgcgcgagaacaagtgcttcgagcagtgcgggggctgggggtgcggctgcttcaacgtcaacccctcctgcctgttcgtgcacacgtacctgcagagcgtgcggaaggaggccctccgcgtcttcaactgcatcgactgggtgcacaagctgaccctggagatcaccgacttcgacgggtccgtgagcaccatcgacctcggcgcgtccagctcccggttcaccaactggggcagcgtctccctgagcctggacgccgaggggatctccggcagcaactccttcagcttcatcgagtccccggggaagggctacgccatcgtggacgagcccttcagcgagatcccccgccaggggttcctcggcgagatccggtgcaactccgagagctccgtgctgagcgcccacgagagctgcctgcgcgcgcccaacctcatctcctacaagccgatgatcgaccagctggagtgcacgaccaacctgatcgaccccttcgtcgtgttcgagcggggcagcctcccccagacccgcaacgacaagaccttcgccgcctccaaggggaaccggggcgtgcaggccttcagcaaggggtccgtccaggccgacctgacgctgatgttcgacaacttcgaggtggacttcgtgggcgcggccgtcagctgcgacgccgccttcctcaacctgaccgggtgctactcctgcaacgccggcgcgcgcgtgtgcctgagcatcacctccaccggcacggggagcctctccgcccacaacaaggacggcagcctgcacatcgtgctgccctccgagaacgggaccaaggaccagtgccagatcctccacttcaccgtcccggaggtggaggaggagttcatgtacagctgcgacggcgacgagcggcccctgctggtgaaggggaccctcatcgccatcgaccccttcgacgaccgccgggaggccggcggcgagtccacggtcgtgaaccccaagagcgggtcctggaacttcttcgactggttcagcggcctgatgtcctggttcgggggcccgctgaagaccatcctcctgatctgcctgtacgtggccctcagcatcggcctgttcttcctgctcatctacctggggcgcaccggcctgagcaagatgtggctcgcggccaccaagaaggcctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17403 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (opt1)
  source 1..3565: mol_type = other RNA
ggggcgctgcctacggaggtggcagccatctccttctcggcatcaagcttaccatggactggacctggatcctgttcctcgtggccgccgcgacccgcgtccacagcccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgcagcgagctgatccaggcctccagccggatcacgacctgctccaccgagggcgtgaacaccaagtgccgcctgagcgggaccgccctcatccgggcgggctccgtcggcgccgaggcctgcctgatgctgaagggggtgaaggaggaccagaccaagttcctcaagatcaagaccgtgagctccgagctgagctgccgcgagggccagtcctactggacggggagcttctcccccaagtgcctgagctcccggcgctgccacctggtcggcgagtgccacgtgaaccgctgcctcagctggcgggacaacgagacctccgccgagttcagcttcgtgggcgagagcaccaccatgcgcgagaacaagtgcttcgagcagtgcgggggctgggggtgcggctgcttcaacgtcaacccctcctgcctgttcgtgcacacgtacctgcagagcgtgcggaaggaggccctccgcgtcttcaactgcatcgactgggtgcacaagctgaccctggagatcaccgacttcgacgggtccgtgagcaccatcgacctcggcgcgtccagctcccggttcaccaactggggcagcgtctccctgagcctggacgccgaggggatctccggcagcaactccttcagcttcatcgagtccccggggaagggctacgccatcgtggacgagcccttcagcgagatcccccgccaggggttcctcggcgagatccggtgcaactccgagagctccgtgctgagcgcccacgagagctgcctgcgcgcgcccaacctcatctcctacaagccgatgatcgaccagctggagtgcacgaccaacctgatcgaccccttcgtcgtgttcgagcggggcagcctcccccagacccgcaacgacaagaccttcgccgcctccaaggggaaccggggcgtgcaggccttcagcaaggggtccgtccaggccgacctgacgctgatgttcgacaacttcgaggtggacttcgtgggcgcggccgtcagctgcgacgccgccttcctcaacctgaccgggtgctactcctgcaacgccggcgcgcgcgtgtgcctgagcatcacctccaccggcacggggagcctctccgcccacaacaaggacggcagcctgcacatcgtgctgccctccgagaacgggaccaaggaccagtgccagatcctccacttcaccgtcccggaggtggaggaggagttcatgtacagctgcgacggcgacgagcggcccctgctggtgaaggggaccctcatcgccatcgaccccttcgacgaccgccgggaggccggcggcgagtccacggtcgtgaaccccaagagcgggtcctggaacttcttcgactggttcagcggcctgatgtcctggttcgggggcccgctgaagaccatcctcctgatctgcctgtacgtggccctcagcatcggcctgttcttcctgctcatctacctggggcgcaccggcctgagcaagatgtggctcgcggccaccaagaaggcctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17404 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (opt1)
  source 1..2050: mol_type = other RNA
ggggcgctgcctacggaggtggcagccatctccttctcggcatcaagcttaccatggactggacctggatcctgttcctcgtggccgccgcgacccgcgtccacagcgaggacccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17405 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (opt1)
  source 1..2044: mol_type = other RNA
ggggcgctgcctacggaggtggcagccatctccttctcggcatcaagcttaccatggactggacctggatcctgttcctcgtggccgccgcgacccgcgtccacagcccccacctccggaaccgcccgggcaaggggcacaactacatcgacggcatgacgcaggaggacgcgacctgcaagcccgtgacctacgccggggcctgctccagcttcgacgtgctgctggagaagggcaagttccccctgttccagtcctacgcccaccaccggaccctgctcgaggccgtccacgacacgatcatcgccaaggccgacccgcccagctgcgacctgctgtccgcccacgggaacccctgcatgaaggagaagctcgtgatgaagacccactgccccaacgactaccagagcgcgcactacctgaacaacgacggcaagatggcctccgtgaagtgcccgcccaagtacgagctgaccgaggactgcaacttctgccgccagatgaccggcgccagcctcaagaaggggtcctaccccctgcaggacctgttctgccagagctccgaggacgacggcagcaagctcaagacgaagatgaagggggtctgcgaggtgggcgtgcaggccctgaagaagtgcgacgggcagctgtccaccgcccacgaggtcgtgcccttcgcggtgttcaagaacagcaagaaggtctacctcgacaagctggacctgaagaccgaggagaacctcctgcccgactccttcgtgtgcttcgagcacaagggccagtacaagggcaccatggacagcgggcagacgaagcgggagctgaagtccttcgacatcagccagtgcccgaagatcggcgggcacggctccaagaagtgcaccggcgacgccgccttctgcagcgcctacgagtgcaccgcccagtacgcgaacgcctactgcagccacgccaacgggtccggcatcgtgcagatccaggtcagcggggtgtggaagaagcccctctgcgtgggctacgagcgcgtcgtggtgaagcgggagctgtccgccaagcccatccagcgcgtcgagccctgcaccacgtgcatcaccaagtgcgagccgcacgggctggtggtgcggagcaccggcttcaagatctccagcgccgtcgcgtgcgcctccggcgtgtgcgtcaccgggagccagtcccccagcacggagatcaccctcaagtaccccggcatctcccagagctccgggggcgacatcggggtgcacatggcccacgacgaccagagcgtgtccagcaagatcgtcgcccactgcccgccccaggacccctgcctggtgcacgactgcatcgtgtgcgcccacggcctgatcaactaccagtgccacaccgcgctctccgccttcgtcgtggtgttcgtcttcagctccatcgccatcatctgcctggccatcctgtaccgcgtgctcaagtgcctgaagatcgcgccccggaaggtgctgaaccccctcatgtggatcaccgccttcatccgctggatctacaagaagatggtcgcccgggtggccgacaacatcaaccaggtgaaccgcgagatcggctggatggagggcgggcagctggtcctggggaacccggcccccatcccccggcacgcgcccatcccgcgctacagcacgtacctcatgctgctgctcatcgtgagctacgcctccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17406 - RNA, 1960 nt, synthetic construct
  misc_feature 1..1960: note = mRNA product Design2 comprising derived and/or modified sequence from RVFV(ZH-548)__DQ380206.1__IgE-leader_Gc (opt1)
  source 1..1960: mol_type = other RNA
ggggcgctgcctacggaggtggcagccatctccttctcggcatcaagcttaccatggactggacctggatcctgttcctcgtggccgccgcgacccgcgtccacagctgctccgagctgatccaggccagctcccggatcacgacctgcagcaccgagggcgtgaacaccaagtgccgcctgtccgggacggccctcatccgggccggcagcgtgggggccgaggcgtgcctgatgctgaagggcgtcaaggaggaccagaccaagttcctcaagatcaagaccgtgtccagcgagctgtcctgccgcgaggggcagagctactggaccggctccttcagccccaagtgcctgtccagccggcgctgccacctcgtgggcgagtgccacgtcaaccggtgcctgtcctggcgcgacaacgagacgagcgccgagttctccttcgtgggggagagcaccaccatgcgggagaacaagtgcttcgagcagtgcggcgggtggggctgcgggtgcttcaacgtgaacccgtcctgcctgttcgtccacacctacctccagagcgtgcgcaaggaggccctgcgggtgttcaactgcatcgactgggtccacaagctgacgctcgagatcaccgacttcgacggcagcgtgtccaccatcgacctgggcgccagctccagccgcttcaccaactgggggtccgtgagcctgtccctcgacgcggagggcatcagcgggtccaacagcttctccttcatcgagagccccggcaagggctacgccatcgtcgacgagcccttctccgagatcccccggcaggggttcctgggcgagatccgctgcaacagcgagtccagcgtgctgtccgcccacgagagctgcctccgggccccgaacctgatctcctacaagcccatgatcgaccagctggagtgcacgaccaacctcatcgaccccttcgtggtcttcgagcgcgggagcctgccccagacccggaacgacaagaccttcgccgcgagcaagggcaaccgcggggtgcaggccttctccaagggcagcgtgcaggccgacctgacgctcatgttcgacaacttcgaggtcgacttcgtgggcgccgccgtgtcctgcgacgcggccttcctgaacctgaccgggtgctacagctgcaacgccggcgcccgggtctgcctctccatcaccagcaccgggacgggctccctgagcgcccacaacaaggacgggtccctgcacatcgtgctcccgagcgagaacggcaccaaggaccagtgccagatcctgcacttcaccgtccccgaggtggaggaggagttcatgtactcctgcgacggcgacgagcgccccctgctcgtgaaggggaccctgatcgcgatcgaccccttcgacgaccggcgcgaggccggcggggagagcacggtcgtgaacccgaagtccggcagctggaacttcttcgactggttctccgggctgatgagctggttcggcggccccctcaagaccatcctgctgatctgcctctacgtggccctgtccatcgggctgttcttcctcctgatctacctgggccgcaccgggctcagcaagatgtggctggccgccaccaagaaggcgagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17407 - RNA, 1120 nt, synthetic construct
  misc_feature 1..1120: note = mRNA product Design2 comprising derived and/or modified sequence from RVFV(ZH-548)__DQ380151.1__N (opt5)
  source 1..1120: mol_type = other RNA
ggggcgctgcctacggaggtggcagccatctccttctcggcatcaagcttaccatggacaactaccaagagctggccatccaattcgctgcccaggcggtggatagaaatgaaattgagcagtgggtccgggaatttgcttatcagggcttcgacgcccgcagagttatcgagctcctgaagcaatacgggggagccgattgggaaaaagacgctaagaaaatgattgtgcttgccctgacccggggcaacaagccccgcagaatgatgatgaaaatgagcaaggaggggaaggctacagtggaggccctcatcaataaatataagctgaaagaaggaaacccttcccgggatgagcttacgctgtctcgcgtcgcggccgctctcgccggctggacctgccaggctctggtggttctgagcgaatggctcccggtgacagggaccacaatggacggactgtcccccgcctaccctagacacatgatgcatccctcttttgcgggcatggtcgatcctagccttcccggcgactatctgcgggccattctcgatgctcactccctgtaccttctgcagttctctcgcgtgatcaatcctaacctcagagggcggaccaaggaggaggttgccgctacatttacccagccgatgaatgccgccgtgaacagcaatttcatctcccatgaaaaacgcagagagtttctgaaggctttcggactggtcgacagcaacggcaagccctctgcggccgtgatggctgccgcccaggcttataaaacggccgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17408 - RNA, 3976 nt, synthetic construct
  misc_feature 1..3976: note = mRNA product Design2 comprising derived and/or modified sequence from RVFV(ZH-548)__DQ380206.1__GP (opt5)
  source 1..3976: mol_type = other RNA
ggggcgctgcctacggaggtggcagccatctccttctcggcatcaagcttaccatgtacgtgctgctcaccatcctgattagcgtccttgtttgcgaggccgtgatcagagtgtccctgtctagcacacgggaagagacgtgtttcggcgactccaccaaccccgaaatgattgagggggcttgggattctctccgcgaagaggagatgcctgaagaactgagctgctccatctctggaattagagaagtcaagacaagctcccaggagctttatcgggccctgaaagcgatcatcgctgccgacggcctcaataacattacctgtcacgggaaggatccggaggacaaaatcagcctgattaagggaccccctcataaaaagcgcgtgggcatcgttagatgcgaacggcgcagagatgccaagcaaattgggcgggagacaatggctggaatcgccatgaccgtgctgcccgctctcgccgtctttgcgctggcccctgtggttttcgctgaagacccccaccttcgcaatagacctggcaaaggccataactacattgatgggatgacacaggaggacgccacctgtaagccggtgacgtatgctggagcctgcagctcctttgatgtcctgctcgaaaaaggcaagttccccctgtttcagagctacgcgcaccatcggacccttctggaggccgtgcacgacacaatcatcgctaaagccgatcctccctcttgtgacctcctgtccgctcacgggaatccttgcatgaaggagaagctggtgatgaaaacccattgtcccaacgattatcagagcgcccactacctcaataacgacggaaagatggcctctgtcaaatgcccgcctaagtatgaactgacagaggactgtaatttctgccgccaaatgaccggcgcttcccttaaaaaggggagctaccccctgcaggatctcttttgccagtcctctgaagacgatggaagcaaactgaagacgaagatgaaaggcgtttgtgaggtgggcgtgcaggcgcttaagaaatgcgacgggcaactgtccacagcccatgaagtcgtgcctttcgctgtttttaagaacagcaaaaaggtgtacctcgataagctggacctgaaaaccgaggagaatctcctgcccgattctttcgtctgttttgaacacaagggacagtataaaggcacaatggactccgggcagaccaagagagagcttaaatctttcgatatttctcagtgccccaagatcggaggccacgggagcaagaaatgtaccggagacgccgccttttgctccgcttacgaatgtacagcccaatatgcgaacgcttactgctctcatgccaatggcagcggcattgtgcagatccaggtttccggggtgtggaagaaacctctgtgtgtcggatatgagcgggtggtcgtgaagcgcgaactcagcgccaaaccgattcaaagagttgagccctgcacgacctgtatcacaaagtgcgagcctcacggcctggtggtccggtctaccgggttcaagatctccagcgctgtggcctgcgcttctggagtttgtgtgacaggctcccagagcccctccaccgaaattacgcttaaataccctgggatctctcagagctccggcggagatattggcgtccatatggcccacgacgaccagtctgtgagctccaagatcgtggcgcattgtcccccgcaagatccttgcctggttcacgactgcattgtctgtgcccacgggctcatcaactatcagtgccatacagctctgagcgccttcgtggtggtctttgtgttctcttccatcgctattatctgtctggccattctctacagagttctgaaatgccttaagatcgcgccccgcaaagtgctgaatcctctcatgtggattaccgcctttatccggtggatttacaagaaaatggtcgctagagtggccgataacatcaaccaggttaatcgcgagatcggatggatggaaggcgggcagctggtgctgggaaaccccgctcctattccccggcacgccccgatccctagatatagcacctaccttatgctcctgctgattgtctcttatgcctccgcttgtagcgagctcatccaagcgtctagccgcattacaacctgctccacagagggcgtgaatacgaagtgtcggctgagcgggaccgcccttatcagagctggctctgttggagccgaagcctgcctgatgctcaagggcgtgaaagaggaccagacaaagttcctgaaaatcaagaccgtctccagcgaactgtcctgccgcgaggggcagtcttactggacaggcagcttttcccccaaatgtctttctagccggagatgccatctcgtgggagaatgtcacgtgaaccgctgcctgtcctggcgggataatgagacctctgctgagttcagctttgtcggggaatccacgaccatgagagagaacaagtgtttcgaacagtgcggaggctgggggtgtggctgctttaatgttaaccccagctgtctgttcgtgcacacatatctccaatctgtgcggaaggaggccctgcgcgtctttaattgcattgactgggtgcataaacttaccctggaaatcacagatttcgacggatccgttagcaccattgatctcggcgcgtcttccagcagatttacgaactgggggtctgtgtccctgagcctggacgctgagggaatctccggcagcaattctttcagcttcattgagtcccctgggaagggatacgccatcgtcgatgaaccgttttctgagatcccccggcagggcttccttggggaaattagatgtaacagcgagtcctctgtgctcagcgcccacgaatcctgcctgcgcgctcctaatctgatctcttataaacccatgattgaccagctcgagtgcacaaccaacctgatcgatccttttgttgtgttcgagcggggcagccttccccagacaagaaatgacaagacctttgccgcgtccaaaggaaaccgcggcgtccaggctttcagcaaggggtctgtgcaagccgacctgaccctcatgtttgataacttcgaagttgactttgtgggagccgctgtctcctgtgatgccgctttcctgaatctgacaggctgctacagctgtaacgccggggcgagagtgtgcctttctattacgtccaccggaacaggcagcctctccgcccataataaggacggctctctgcacatcgtgctgcctagcgagaacgggaccaaagatcagtgtcaaatcctccattttacagtccccgaagttgaggaggagttcatgtactcctgcgacggagatgagcggccgctgcttgtgaagggcaccctgattgctatcgacccttttgatgaccgcagagaagccgggggagagagcacggtggtcaatcccaaatctggctcctggaacttcttcgattggtttagcgggctcatgtcttggttcggaggccctctgaagacaattctgcttatctgtctgtatgtggctctcagcattggcctgtttttcctcctgatctaccttgggcggaccggactgtccaaaatgtggctcgccgccaccaagaaggcttcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17409 - RNA, 3586 nt, synthetic construct
  misc_feature 1..3586: note = mRNA product Design2 comprising derived and/or modified sequence from RVFV(ZH-548)__DQ380206.1__Gn-Gc (opt5)
  source 1..3586: mol_type = other RNA
ggggcgctgcctacggaggtggcagccatctccttctcggcatcaagcttaccatggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccctgtccgctttcgtggttgtgttcgtctttagctctattgccatcatttgcctggctatcctctacagagtgctgaagtgtcttaaaattgcgccccggaaggtgctgaaccctctcatgtggatcaccgccttcatccgctggatttataaaaagatggttgccagagtcgctgacaatatcaaccaagtgaatcgggaaattgggtggatggagggaggccagctggtgcttgggaaccccgccccgatccctcgccacgctcccattcctagatactccacatacctgatgctcctgctgatcgtcagctatgcctccgcgtgctctgaactcatccaggccagctcccggattaccacatgttctaccgagggcgtgaacacgaagtgccgcctgagcggaacagctcttatcagagccggctccgttggggctgaagcctgtctgatgctcaaaggagtgaaggaggatcagaccaaatttctgaagattaaaaccgtcagctctgagctgtcctgccgggaaggccaaagctactggacagggtctttctcccccaagtgtcttagctctagacgctgccatctcgtgggagagtgtcacgttaatcggtgcctgagctggagagacaacgaaacctccgccgagtttagcttcgtgggcgaatctacaacgatgcgcgagaataaatgctttgagcagtgtgggggctggggatgcggctgtttcaacgtcaatccttcctgcctgtttgtgcatacctatctccagagcgttcggaaggaagctctgagagtgttcaactgtatcgactgggtccacaaacttacactggagattaccgattttgacgggtccgtgtctacaatcgatctcggagcgagctcctctcgcttcaccaattggggcagcgtgtccctgtctctggacgccgaagggattagcggatccaacagcttttctttcatcgagtcccccggcaaagggtacgctatcgtcgatgagccgttcagcgaaattcctcggcagggctttcttggagagatcagatgcaattctgaatccagcgttctctctgcccacgagtcctgtctgcgcgcccccaacctgattagctataagcccatgatcgaccaactcgaatgcacgaccaatctgattgatcctttcgtggtgtttgagcggggctcccttccgcagacaagaaacgacaaaaccttcgctgccagcaaggggaatcgcggagtccaggcgttttctaaaggcagcgtgcaggctgatctgacactcatgttcgacaactttgaggttgatttcgtgggggccgccgtctcctgtgacgctgcctttctgaatctgaccggatgctactcttgtaacgcgggcgctcgggtgtgccttagcatcacgtccacagggaccggctctctcagcgcccataacaaggatggatccctgcacatcgttctgccctctgaaaatggcacaaaggaccaatgccagattctccatttcaccgtgcctgaggtcgaagaggaatttatgtatagctgtgacggggatgagagacccctgcttgtgaaaggaaccctgatcgccattgaccctttcgatgaccggcgcgaggctggcggggaatccacagttgtgaaccccaagagcggatcttggaactttttcgattggttctccggcctcatgagctggtttggcgggcctctgaaaacgatcctgcttatttgcctctacgtcgccctgtctatcggactgttctttctcctgatctaccttggcagaaccgggctgtccaagatgtggctcgctgccacaaagaaggcgagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17410 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (opt5)
  source 1..3337: mol_type = other RNA
ggggcgctgcctacggaggtggcagccatctccttctcggcatcaagcttaccatggccggcatcgctatgaccgtgctgcccgccctcgcggtcttcgctctggcccctgttgtgtttgccgaggacccgcaccttagaaatcggcccgggaagggacataattacattgatggcatgacacaggaagacgctacgtgcaaacctgtgacctatgccggggcttgtagctccttcgatgtcctgctcgagaagggaaaatttcccctgttccaatcttacgcccaccatcgcacacttctggaagcggtgcacgacaccatcattgccaaggctgatcctcccagctgcgacctcctgtccgcccatggcaacccttgtatgaaagagaagctggttatgaagacacactgcccgaatgattatcagtctgctcactacctcaacaatgacgggaaaatggccagcgtgaagtgtccccctaaatatgaactgaccgaggattgcaacttttgtagacagatgacaggagcgtcccttaagaaaggctcttaccccctgcaggacctcttctgccaaagctccgaggatgacggcagcaagctgaagaccaaaatgaagggggtctgtgaagtgggagttcaggcccttaaaaagtgcgatggccagctgtctacggctcatgaggtggtcccttttgccgtgttcaaaaattccaagaaagtgtatctcgacaagctggacctgaagaccgaagagaacctcctgcccgatagctttgtctgtttcgagcacaaagggcagtacaagggaacaatggactctggccaaaccaaacgggaacttaagtcctttgatatcagccagtgcccgaaaattgggggacatggctctaagaagtgcacaggcgacgctgccttctgttccgcctacgagtgcaccgctcagtatgcgaatgcctactgtagccacgctaacgggtccggaatcgttcagatccaagtgtctggcgtgtggaaaaagcctctgtgcgtcgggtatgaacgcgtggttgtgaaaagagagctcagcgccaagcccattcagcgggtcgaaccttgtacgacatgcatcaccaaatgtgagccccacggactggtggttcgctccacaggctttaagattagctctgccgtggcttgcgcctccggggtctgtgtgaccggaagccagtctcccagcaccgagatcacacttaagtaccctggcatttcccaatctagcggcggggatatcggagtccatatggcgcacgacgatcagtccgtgagctctaaaattgttgctcattgcccgccccaggacccttgtctggtgcacgattgcatcgtctgcgcccatggcctcatcaattatcagtgtcacacggccatggctgggattgccatgaccgtgctgcccgctctggccgttttcgcgctcgcccctgtggtcttcgctgaagactgctccgagctgatccaagccagctctagaattacaacctgttccacagaaggagtgaacaccaagtgccggcttagcggcacggctctgatccgcgccgggtccgtgggcgcggaggcctgtctcatgctgaaaggagttaaggaagatcagacaaaatttcttaagattaagaccgtctctagcgagctgtcctgcagagagggccagtcttactggaccgggagcttctcccccaaatgtctcagctctcggcgctgccacctggtgggagaatgtcatgtgaatagatgcctgtcctggcgggacaacgagacaagcgctgaattttctttcgtcggcgagtccaccacaatgcgcgaaaataagtgttttgagcagtgcgggggatggggctgcgggtgtttcaacgtgaacccgagctgcctctttgttcacacgtatctgcaatctgtgagaaaagaggcccttcgggtcttcaattgtatcgactgggtgcataagctgaccctcgaaatcacagattttgacggcagcgtttccaccattgatctgggagcttctagctccagattcacaaactggggcagcgtgtccctgtctcttgacgccgaggggatcagcggatccaattcttttagcttcattgaatcccctggcaaagggtacgccatcgtcgatgagcccttttctgagattcctcgccagggattcctcggcgaaatccggtgcaacagcgagtccagcgtgctgtctgctcacgaatcctgtctgagagcgcccaatctcatcagctacaagcctatgattgaccagctggagtgcaccacgaaccttatcgatcccttcgttgtgtttgaacgcgggtctctgccgcagacccggaatgacaaaacattcgccgcttccaagggcaacagaggagtccaagcctttagcaagggctctgtgcaggccgatctcaccctgatgttcgacaattttgaggtggatttcgtcggggctgccgtttcctgtgacgcggcttttctgaaccttacaggatgctatagctgtaatgccggcgcccgcgtgtgcctctccattaccagcacggggacaggatctctgagcgctcacaacaaagatggctccctgcatatcgtgctcccttctgagaatgggaccaaggaccagtgtcagattctgcacttcacagtccccgaagtggaggaagagtttatgtacagctgcgacggcgatgaacggccccttctggttaaaggaaccctcatcgccattgaccctttcgatgacagacgcgaggcgggcggggagtccaccgtggtcaacccgaagtctggaagctggaactttttcgattggttttccggcctgatgtcttggttcgggggacccctgaaaacaatccttctcatctgcctgtatgtggctctgagcattggcctcttctttctgcttatctacctgggccggacggggctctccaagatgtggctggccgccaccaagaaagctagctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17411 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (opt5)
  source 1..3571: mol_type = other RNA
ggggcgctgcctacggaggtggcagccatctccttctcggcatcaagcttaccatggactggacctggatcctgttcctcgtggccgctgccacaagagtccacagcgaggatccccatctgcggaaccgccctggcaaggggcacaattacattgacggaatgacgcaggaagatgcgacctgcaaaccggttacatatgctggcgcctgttcctcttttgacgtgcttctggagaaggggaaattccccctctttcaaagctacgcccatcacagaaccctgcttgaagctgtgcatgatacaatcattgccaaggctgaccctccctcctgcgatctgctctctgcccacggaaacccttgtatgaaagagaagctggtcatgaagacccactgccccaatgactatcagagcgcgcattacctgaacaatgatggcaaaatggcctccgtgaagtgtcctccgaaatatgaactcacagaggactgcaacttctgtcggcagatgaccggggcttctctgaagaaaggaagctacccccttcaggatctgttttgccaatccagcgaggacgatggctctaagctcaagacgaaaatgaagggcgtttgtgaagtgggggtccaggccctgaaaaagtgcgacggacagctttccaccgctcacgaggtggttcctttcgccgtgtttaaaaatagcaagaaagtctatctggacaagctcgatctgaagacagaagagaacctgctccccgactctttcgtgtgttttgagcataaaggccagtacaaggggaccatggattccggacaaacaaaacgcgaacttaagagcttcgacatctctcagtgccctaaaattggcgggcacggatccaagaagtgcaccggcgatgcggccttttgtagcgcttacgagtgcacggcccagtatgctaatgcctactgttcccacgccaacggctctgggatcgtgcagatccaagtcagcggagtttggaaaaagcccctgtgcgtgggctatgaaagagtggtcgtgaaacgggagctgtccgctaagccgattcagcgcgttgaaccttgtacaacctgcatcacaaaatgtgagccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgacatcggggtccacatggcccatgatgaccagagcgtgtcttccaaaattgtcgcccactgtccccctcaggatccgtgccttgtgcatgactgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgataatatcaaccaagttaatcgcgaaattggctggatggaagggggacagctcgtcctgggcaaccccgcccctatccccagacatgcgccgattcctcggtacagcacctaccttatgctgctcctgatcgtgtcctatgcctctgcttgcagcgaactgatccaggcctcctctcgcattacaacctgtagcacggagggggtgaacacaaagtgcagactctccggcaccgctctgatccgggccggaagcgtcggcgcggaagcctgtcttatgctgaaaggggtgaaggaggaccagaccaaattcctcaagattaaaacagtttcttccgagctgagctgcagagaaggacaatcttactggaccggctcctttagccccaagtgtctgtctagccgccggtgccaccttgtgggggagtgtcatgtcaatagatgcctctcctggcgcgacaacgaaacaagcgctgagttctcttttgtgggagaatccacgaccatgcgggagaataaatgcttcgagcagtgtggcgggtggggctgcggatgttttaacgttaatcctagctgcctgttcgtgcacacatatctgcagtccgtcagaaaggaagccctccgcgtgtttaactgtatcgattgggttcacaagctgacccttgagattacagacttcgatggctctgtgagcaccatcgacctgggggcttcctctagccggtttacgaattggggatccgtctctctcagcctggatgccgaaggcatttccgggagcaactctttctcctttatcgagagccccggaaaaggctacgccatcgtggacgagcctttctctgaaattcccagacaggggttcctgggcgagatccgctgcaattccgaaagctctgtgctttccgctcatgagagctgtctccgggcgccgaacctgatttcctataagcctatgatcgatcaactggaatgcaccacaaatctcattgacccctttgtcgttttcgagagaggaagcctgccccagacccgcaacgataaaacatttgccgcttctaagggcaatagaggggtgcaggccttcagcaaaggatccgtgcaggccgaccttaccctgatgtttgataacttcgaggtcgactttgtgggcgctgccgtttcttgtgatgcggctttcctcaatctgacggggtgctacagctgtaacgccggagcccgggtgtgcctgtccatcacatctaccggcacagggagcctttccgctcacaacaaggacggctctctccatatcgtcctgcctagcgaaaatggaaccaaggaccaatgccagattctgcactttaccgtgccggaggttgaagaggagttcatgtattcctgtgatggcgacgagcggcccctcctggtgaaagggacacttatcgccattgatccttttgacgatcgcagagaggcgggaggcgaaagcacggtcgtgaaccccaagtctgggtcctggaatttctttgactggttcagcggactgatgtcttggttcggcggccctctcaaaaccatcctgctgatttgcctttacgttgctctctccatcgggctgtttttcctgctcatctacctgggacggacaggccttagcaagatgtggctggccgccaccaaaaaggcttcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17412 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (opt5)
  source 1..3565: mol_type = other RNA
ggggcgctgcctacggaggtggcagccatctccttctcggcatcaagcttaccatggactggacctggatcctgttcctcgtggccgctgccacaagagtccacagcccccatctgcggaaccgccctggcaaggggcacaattacattgatggaatgacgcaggaggacgcgacctgcaaaccggttacatatgctggcgcctgttcctcttttgatgtgcttctggaaaaggggaaattccccctctttcaaagctacgcccatcacagaaccctgcttgaggctgtgcatgacacaatcattgccaaggctgatcctccctcctgcgacctgctctctgcccacggaaacccttgtatgaaagaaaagctggtcatgaagacccactgccccaatgattatcagagcgcgcattacctgaacaatgacggcaaaatggcctccgtgaagtgtcctccgaaatatgagctcacagaagattgcaacttctgtcggcagatgaccggggcttctctgaagaaaggaagctacccccttcaggacctgttttgccaatccagcgaggatgacggctctaagctcaagacgaaaatgaagggcgtttgtgaggtgggggtccaggccctgaaaaagtgcgatggacagctttccaccgctcacgaagtggttcctttcgccgtgtttaaaaatagcaagaaagtctatctggacaagctcgacctgaagacagaggaaaacctgctccccgattctttcgtgtgttttgagcataaaggccagtacaaggggaccatggactccggacaaacaaaacgcgagcttaagagcttcgatatctctcagtgccctaaaattggcgggcacggatccaagaagtgcaccggcgacgcggccttttgtagcgcttacgaatgcacggcccagtatgctaatgcctactgttcccacgccaacggctctgggatcgtgcagatccaagtcagcggagtttggaaaaagcccctgtgcgtgggctatgagagagtggtcgtgaaacgggaactgtccgctaagccgattcagcgcgttgagccttgtacaacctgcatcacaaaatgtgaaccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgatatcggggtccacatggcccatgacgatcagagcgtgtcttccaaaattgtcgcccactgtccccctcaggacccgtgccttgtgcatgattgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgacaatatcaaccaagttaatcgcgagattggctggatggaagggggacagctcgtcctgggcaaccccgcccctatccccagacatgcgccgattcctcggtacagcacctaccttatgctgctcctgatcgtgtcctatgcctctgcttgcagcgagctgatccaggcctcctctcgcattacaacctgtagcacggaaggggtgaacacaaagtgcagactctccggcaccgctctgatccgggccggaagcgtcggcgcggaggcctgtcttatgctgaaaggggtgaaggaagatcagaccaaattcctcaagattaaaacagtttcttccgagctgagctgcagagagggacaatcttactggaccggctcctttagccccaagtgtctgtctagccgccggtgccaccttgtgggggaatgtcatgtcaatagatgcctctcctggcgcgacaacgagacaagcgctgagttctcttttgtgggagaatccacgaccatgcgggaaaataaatgcttcgagcagtgtggcgggtggggctgcggatgttttaacgttaatcctagctgcctgttcgtgcacacatatctgcagtccgtcagaaaggaggccctccgcgtgtttaactgtatcgactgggttcacaagctgacccttgaaattacagatttcgacggctctgtgagcaccatcgatctgggggcttcctctagccggtttacgaattggggatccgtctctctcagcctggacgccgagggcatttccgggagcaactctttctcctttatcgaaagccccggaaaaggctacgccatcgtggatgagcctttctctgagattcccagacaggggttcctgggcgaaatccgctgcaattccgagagctctgtgctttccgctcatgaaagctgtctccgggcgccgaacctgatttcctataagcctatgatcgaccaactggagtgcaccacaaatctcattgatccctttgtcgttttcgaaagaggaagcctgccccagacccgcaacgacaaaacatttgccgcttctaagggcaatagaggggtgcaggccttcagcaaaggatccgtgcaggccgatcttaccctgatgtttgacaacttcgaggtcgattttgtgggcgctgccgtttcttgtgacgcggctttcctcaatctgacggggtgctacagctgtaacgccggagcccgggtgtgcctgtccatcacatctaccggcacagggagcctttccgctcacaacaaggatggctctctccatatcgtcctgcctagcgagaatggaaccaaggaccaatgccagattctgcactttaccgtgccggaagttgaggaagagttcatgtattcctgtgacggcgatgaacggcccctcctggtgaaagggacacttatcgccattgacccttttgatgaccgcagagaggcgggaggcgagagcacggtcgtgaaccccaagtctgggtcctggaatttctttgattggttcagcggactgatgtcttggttcggcggccctctcaaaaccatcctgctgatttgcctttacgttgctctctccatcgggctgtttttcctgctcatctacctgggacggacaggccttagcaagatgtggctggccgccaccaaaaaggcttcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17413 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (opt5)
  source 1..2050: mol_type = other RNA
ggggcgctgcctacggaggtggcagccatctccttctcggcatcaagcttaccatggactggacctggatcctgttcctcgtggccgctgccacaagagtccacagcgaggatccccatctgcggaaccgccctggcaaggggcacaattacattgacggaatgacgcaggaggatgcgacctgcaaaccggttacatatgctggcgcctgttcctcttttgacgtgcttctggagaaggggaaattccccctctttcaaagctacgcccatcacagaaccctgcttgaagctgtgcatgatacaatcattgccaaggctgaccctccctcctgcgatctgctctctgcccacggaaacccttgtatgaaagagaagctggtcatgaagacccactgccccaatgactatcagagcgcgcattacctgaacaatgatggcaaaatggcctccgtgaagtgtcctccgaaatatgaactcacagaggactgcaacttctgtcggcagatgaccggggcttctctgaagaaaggaagctacccccttcaggatctgttttgccaatccagcgaggacgatggctctaagctcaagacgaaaatgaagggcgtttgtgaagtgggggtccaggccctgaaaaagtgcgacggacagctttccaccgctcacgaggtggttcctttcgccgtgtttaaaaatagcaagaaagtctatctggacaagctcgatctgaagacagaagagaacctgctccccgactctttcgtgtgttttgagcataaaggccagtacaaggggaccatggattccggacaaacaaaacgcgaacttaagagcttcgacatctctcagtgccctaaaattggcgggcacggatccaagaagtgcaccggcgatgcggccttttgtagcgcttacgagtgcacggcccagtatgctaatgcctactgttcccacgccaacggctctgggatcgtgcagatccaagtcagcggagtttggaaaaagcccctgtgcgtgggctatgaaagagtggtcgtgaaacgggagctgtccgctaagccgattcagcgcgttgaaccttgtacaacctgcatcacaaaatgtgagccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgacatcggggtccacatggcccatgatgaccagagcgtgtcttccaaaattgtcgcccactgtccccctcaggatccgtgccttgtgcatgactgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgataatatcaaccaagttaatcgcgaaattggctggatggaagggggacagctcgtcctgggcaaccccgcccctatccccagacatgcgccgattcctcggtacagcacctaccttatgctgctcctgatcgtgtcctatgcctctgcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17414 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (opt5)
  source 1..2044: mol_type = other RNA
ggggcgctgcctacggaggtggcagccatctccttctcggcatcaagcttaccatggactggacctggatcctgttcctcgtggccgctgccacaagagtccacagcccccatctgcggaaccgccctggcaaggggcacaattacattgatggaatgacgcaggaggacgcgacctgcaaaccggttacatatgctggcgcctgttcctcttttgatgtgcttctggaaaaggggaaattccccctctttcaaagctacgcccatcacagaaccctgcttgaggctgtgcatgacacaatcattgccaaggctgatcctccctcctgcgacctgctctctgcccacggaaacccttgtatgaaagaaaagctggtcatgaagacccactgccccaatgattatcagagcgcgcattacctgaacaatgacggcaaaatggcctccgtgaagtgtcctccgaaatatgagctcacagaagattgcaacttctgtcggcagatgaccggggcttctctgaagaaaggaagctacccccttcaggacctgttttgccaatccagcgaggatgacggctctaagctcaagacgaaaatgaagggcgtttgtgaggtgggggtccaggccctgaaaaagtgcgatggacagctttccaccgctcacgaagtggttcctttcgccgtgtttaaaaatagcaagaaagtctatctggacaagctcgacctgaagacagaggaaaacctgctccccgattctttcgtgtgttttgagcataaaggccagtacaaggggaccatggactccggacaaacaaaacgcgagcttaagagcttcgatatctctcagtgccctaaaattggcgggcacggatccaagaagtgcaccggcgacgcggccttttgtagcgcttacgaatgcacggcccagtatgctaatgcctactgttcccacgccaacggctctgggatcgtgcagatccaagtcagcggagtttggaaaaagcccctgtgcgtgggctatgagagagtggtcgtgaaacgggaactgtccgctaagccgattcagcgcgttgagccttgtacaacctgcatcacaaaatgtgaaccccatgggctcgtggtcagaagcaccggattcaagatttcttccgcggtggcctgcgctagcggcgtttgtgtgaccgggtctcagagcccttccacagagatcacgctgaagtaccccggaatttctcaaagctccggcggcgatatcggggtccacatggcccatgacgatcagagcgtgtcttccaaaattgtcgcccactgtccccctcaggacccgtgccttgtgcatgattgcatcgtttgcgctcacggactgatcaattatcagtgtcacaccgccctcagcgcgtttgtggtcgtgttcgttttctcttccattgctatcatttgcctggccatcctgtaccgggtgctcaagtgtctgaaaattgctccccgcaaggtccttaaccctctgatgtggatcacagcctttatcagatggatttataaaaagatggtggcccgggtggctgacaatatcaaccaagttaatcgcgagattggctggatggaagggggacagctcgtcctgggcaaccccgcccctatccccagacatgcgccgattcctcggtacagcacctaccttatgctgctcctgatcgtgtcctatgcctctgcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17415 - RNA, 1960 nt, synthetic construct
  misc_feature 1..1960: note = mRNA product Design2 comprising derived and/or modified sequence from RVFV(ZH-548)__DQ380206.1__IgE-leader_Gc (opt5)
  source 1..1960: mol_type = other RNA
ggggcgctgcctacggaggtggcagccatctccttctcggcatcaagcttaccatggactggacatggatcctgttcctcgtggccgctgccacaagagtccacagctgctccgagctgattcaggcgtctagccggatcacgacctgttccacagaaggcgttaataccaagtgccgcctttctgggacagctctgattagagccggaagcgtgggcgccgaggcttgtctcatgctgaaaggggtgaaggaagatcaaaccaaatttcttaagatcaaaacagtctcctctgagctgagctgccgggaaggacagtcctactggaccggcagcttctctcccaagtgtctctccagccgcagatgccatctggtgggggagtgtcacgttaatcggtgcctgtcttggcgcgacaacgagacgtccgccgaatttagcttcgtgggagagtctaccacaatgagagaaaataagtgttttgagcagtgcggcggctgggggtgtggatgcttcaacgtcaatccttcctgcctctttgtgcatacctatctgcagagcgttcggaaagaggctctccgcgtgttcaactgtattgattgggtccacaagctgacactcgaaatcaccgactttgatggctccgtgtctacgatcgacctgggggccagctccagcagattcacaaattggggatctgtgtcccttagcctggatgcggagggcatttctgggagcaactccttttctttcatcgaaagcccgggaaaaggctacgccattgtcgacgagcccttttccgaaatccctcggcaaggcttcctcggggagattcgctgcaatagcgagtcttccgttctgagcgctcatgaatcttgtctgagagcccccaacctcatctcctataagcctatgattgatcagctggagtgcaccacaaatcttatcgaccccttcgtggtgtttgaacggggaagcctgcctcagacccgcaacgataaaaccttcgctgcctccaagggcaatagaggggtccaggcgttttctaagggaagcgtgcaagccgacctcacactgatgttcgataactttgaggttgacttcgtgggcgctgccgtctcctgtgacgctgcctttcttaatctgacggggtgctactcttgtaacgccggagctcgggtgtgcctcagcatcacctccacaggcaccggcagcctgtctgcgcacaacaaagatgggtccctgcacattgttctcccgagcgaaaatggaacaaaggaccagtgtcagatcctgcatttcaccgtgcccgaggtcgaggaagagtttatgtattcttgcgatggcgacgaaagacctcttctggtgaaagggacgctcattgccatcgatcccttcgacgatcgccgggaggctggaggcgaatccacagtcgtgaaccctaagagcgggtcttggaactttttcgactggtttagcggcctgatgtcctggttcggaggcccccttaaaaccattctgctcatctgtctgtacgttgccctgagcatcgggcttttctttctgcttatttatctgggaagaaccggcctctctaagatgtggctggccgctaccaaaaaggcctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17416 - RNA, 1120 nt, synthetic construct
  misc_feature 1..1120: note = mRNA product Design2 comprising derived and/or modified sequence from RVFV(ZH-548)__DQ380151.1__N (opt11)
  source 1..1120: mol_type = other RNA
ggggcgctgcctacggaggtggcagccatctccttctcggcatcaagcttaccatggacaactaccaagaactcgcaatccagttcgccgcccaagccgtcgaccgcaacgaaatcgaacaatgggtccgagaatttgcctaccaaggcttcgacgcccgacgagtcatcgaactcctcaaacaatacggaggcgccgactgggaaaaagacgccaagaaaatgatcgtactagccctcacccgaggcaacaaaccccgccgaatgatgatgaaaatgtcaaaagaaggcaaagccaccgtcgaagccctcatcaacaaatacaaactcaaggaaggcaacccctcccgggacgaactcacactctcccgcgtagccgcagccctcgccggctggacctgccaagccctcgtcgtcctatccgaatggcttccagtcacaggcacaaccatggacggcctctcccccgcctatccccgccacatgatgcacccctcattcgccggcatggtcgacccctcactccccggcgactacctacgagccatcctagacgcacactccctctacctcctccaattctcccgcgtcatcaaccccaacctacgcggccgcaccaaagaagaagtagccgccaccttcacacaaccaatgaacgccgcagtcaactccaacttcatctcccacgaaaaacgccgcgaatttctcaaagccttcggccttgtagactccaacggcaaaccctccgccgccgtcatggctgccgcacaagcgtacaaaaccgccgcataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17417 - RNA, 3976 nt, synthetic construct
  misc_feature 1..3976: note = mRNA product Design2 comprising derived and/or modified sequence from RVFV(ZH-548)__DQ380206.1__GP (opt11)
  source 1..3976: mol_type = other RNA
ggggcgctgcctacggaggtggcagccatctccttctcggcatcaagcttaccatgtacgttctgctcaccatactcatctccgtcctcgtctgtgaagcagttattcgggtctcactatcgagcactcgggaagagacatgcttcggagactccaccaatccagaaatgatagagggtgcctgggactcattacgagaggaagaaatgccagaggaactctcgtgctcaatatcgggcattcgggaggtcaaaacgtccagtcaagagctatatcgcgcactgaaagcaatcattgcagccgacggactcaataacatcacgtgccatggaaaagacccagaggacaaaatatcactaatcaagggcccaccacacaagaaacgagtcggcatagtccgatgcgaacgtcgccgcgacgccaaacaaatcggtcgagaaaccatggccggaatcgcaatgaccgtactacccgccctcgcggttttcgccctagcacccgtcgtcttcgcggaagacccccacctccgcaaccggccaggcaaaggtcacaactatatagacggaatgacgcaggaagacgcaacatgtaaaccagtaacctatgccggcgcatgcagctcatttgacgtcctcctcgagaaaggcaagttcccgctattccaaagctacgctcaccaccgcaccctcctggaggccgtacacgacacaataatcgcgaaagcggacccacccagttgcgatctactatcggcccacggaaatccctgtatgaaagaaaagctagttatgaaaacccattgccccaacgactaccagagcgcccactacctcaacaatgatgggaaaatggcctcagtcaaatgcccgcccaaatacgaactaaccgaggactgcaacttctgccgccaaatgaccggagcctcactaaagaaaggctcttaccccctccaagacctcttttgccaatcgtccgaggacgatggctcaaaacttaaaacaaaaatgaaaggtgtctgcgaagtcggagtgcaagccctgaagaaatgtgacggacaactctccacagcccacgaagtagtacccttcgccgtattcaaaaactcaaagaaagtatacctggacaaactggaccttaaaacagaggaaaacctgctgcccgactcctttgtgtgcttcgaacacaaaggccaatacaaaggcactatggacagcggacagaccaaacgggaactaaagagcttcgacatctcccaatgtcccaaaattggcggccacggatccaagaaatgtacaggggacgccgccttctgctcagcctacgaatgcaccgcgcaatacgctaacgcgtactgctcccatgccaacgggtccggcatcgtccagatccaagtctccggcgtgtggaagaaacctctctgtgtaggctatgaacgcgtcgtagtcaaaagagaactctctgctaaacccatccaacgggtggaaccatgcaccacgtgcataacaaaatgcgagccacacggcctcgttgttcgatccacaggctttaaaatctcaagcgctgtagcctgcgcatccggcgtctgcgtcaccggttctcagtccccatcaacagagatcacactgaaataccccggcatatcccaatcatcgggcggcgacataggagttcacatggctcacgacgaccagagcgtatcctccaaaatcgtcgcccactgcccaccccaggacccctgcctcgttcatgactgcatcgtctgtgcacacggcctcataaactaccaatgccacaccgccctatccgcctttgtcgtggtattcgtattcagcagcatcgcaatcatatgccttgcaatcctgtaccgcgtcctgaaatgccttaaaattgccccacgcaaagtcctcaacccactgatgtggatcactgccttcatacgctggatatacaagaaaatggtcgcccgcgtagccgacaacatcaaccaagtaaaccgagagataggctggatggagggcggccaactcgtccttggcaacccagccccaatacccaggcacgcaccgattcctcggtattccacatacctcatgctccttctgatcgtcagctacgcatcggcctgctccgaactcatacaggcatccagcagaattacaacctgttcaaccgagggcgtcaacacgaaatgtcgtctgtccggtaccgcactaatacgcgctggttcagtaggagcggaggcctgtcttatgcttaaaggcgtaaaagaggatcaaaccaaattcctgaaaatcaaaacagtgagctcggaactctcatgccgcgaaggacaatcctactggacaggatcgttctcaccaaaatgcctatctagcagacgatgccacctcgtcggggagtgccatgtgaatcgctgcctctcctggcgagacaacgagacaagcgccgagttctctttcgtaggggaaagcaccaccatgagagaaaacaaatgcttcgaacagtgcggcggatggggatgcggctgctttaacgtcaacccctcgtgcctgtttgtacatacttacctccaatcagtacgcaaagaagcattgcgcgttttcaattgcatcgactgggtccacaaactcaccctagaaatcacagacttcgacggctccgtctcgaccatcgacctgggcgccagctcctcaaggttcacgaactggggctccgtatccctctcccttgacgcggaaggaatctccggcagcaactcgttctcattcatcgaatcacccggaaaaggctacgccatcgtcgacgaacccttctccgaaataccgagacaaggattcctcggagaaatcagatgcaactcagagagctccgtgctgtctgcccacgaaagttgcctcagagcacccaacctcatcagctacaaaccaatgatcgatcaactagaatgcactactaacctaatagacccctttgtcgttttcgaacgcggctccctcccacaaaccaggaacgacaaaacctttgcagctagtaaaggaaacagaggagtccaagcgttctcaaaaggctcagtccaagcagatctaaccctcatgttcgacaacttcgaggttgacttcgtgggcgccgcagtctcctgtgacgcagcgttcttgaacctcacaggctgctactcttgcaacgccggagcaagagtttgcctctcaatcacgagcacaggaacgggatccctatcagcccacaacaaagacggcagccttcacatcgtactcccgtctgagaacggaaccaaagatcaatgtcaaatcctacacttcaccgtacccgaagtcgaagaagagttcatgtactcttgcgacggcgacgaacgaccactactcgtcaaagggaccctcatcgcaattgacccattcgatgatcgccgcgaagctggaggcgagagcacagtcgtcaaccccaaaagcggctcctggaactttttcgactggttcagcggactcatgtcctggtttggtggcccactcaaaacaatcctcctcatctgcctctacgtagccctgagcatcggcctcttcttcctccttatctacctagggcgaacagggctttcgaaaatgtggcttgctgccaccaagaaagcctcctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17418 - RNA, 3586 nt, synthetic construct
  misc_feature 1..3586: note = mRNA product Design2 comprising derived and/or modified sequence from RVFV(ZH-548)__DQ380206.1__Gn-Gc (opt11)
  source 1..3586: mol_type = other RNA
ggggcgctgcctacggaggtggcagccatctccttctcggcatcaagcttaccatggcaggaatagcaatgacggttctgccagcgctagccgttttcgcactagcaccagtcgtcttcgcggaagacccccatctacgcaaccgacccggaaaaggacacaactacatcgacggaatgacacaagaagatgcaacatgcaaaccagtcacatacgcaggcgcctgctcctccttcgacgtcctacttgagaaaggtaaattccccctctttcaaagctacgcgcaccaccgtaccctcctcgaagcagtccacgacacaatcatagcaaaggctgacccacccagctgtgacctcctctccgcccatggcaacccctgcatgaaggaaaaactcgtaatgaaaacacactgcccgaacgactaccaatccgcccactacctcaacaacgacggaaagatggcctctgttaagtgcccaccaaaatacgagctgaccgaagactgcaacttttgccgtcaaatgaccggagcctccctcaagaaagggtcatacccactccaagatctattttgccaaagctccgaggacgacggcagcaaattaaaaaccaagatgaaaggtgtatgcgaagtgggcgtccaggccctcaagaaatgcgacggccaactttccactgcacacgaagtggtacccttcgccgtgttcaaaaactccaagaaagtctatttagacaaactcgacctaaaaacggaagagaacctcctacccgactcatttgtctgctttgagcacaaaggccaatacaaaggaacaatggatagcgggcaaacaaaaagggaactcaagtccttcgacatcagccagtgccccaaaatcggcggacatgggagcaaaaagtgcaccggcgacgctgcattctgcagtgcctacgagtgcaccgcgcaatacgctaacgcatactgcagtcatgctaacggcagcggaattgtacaaatccaggtctccggcgtgtggaagaaaccactatgcgtaggctacgaacgggttgtcgtcaaaagagagctttccgccaaacccattcaacgagttgaaccatgcactacatgtatcaccaaatgtgaacctcatggtctagttgtccgctcgaccggattcaagatctcgagcgccgtagcctgcgcctccggagtgtgcgtcacaggctcacaatccccctcgacagaaattaccctgaaataccctggaatctcccagtcctcgggaggcgacataggggtacacatggcccacgacgaccaaagcgtctcctccaaaatagtagctcactgcccaccacaggacccctgtctcgtacacgactgcatagtatgtgcacatggtctcatcaactaccaatgccacacagcactcagtgcatttgtagttgtattcgtattctcctctatcgccatcatctgcctagccatactctacagggtcctcaaatgcctaaaaatcgcaccacgaaaagtcctcaaccccctaatgtggataaccgccttcatccgctggatatacaagaaaatggtcgcccgcgtcgcagacaacatcaatcaagtcaaccgtgaaatcggctggatggaaggaggacaactggtccttggaaacccagcgccaataccccgccacgccccaattcctcgatactccacctacctaatgcttctcctaatcgtatcctacgcctccgcctgcagcgaactcatacaggcttcctcacgcataactacgtgctccaccgaaggagttaacaccaaatgccgactctcagggacagccctaatcagagcgggaagtgtaggcgcagaagcctgccttatgctgaaaggagtcaaagaggaccaaacaaaattcctaaagatcaaaaccgtctcatctgagctcagctgccgcgaaggacaatcctactggacaggttccttctcccccaaatgcctgtcatcccgcagatgccatttagtcggcgagtgccatgtaaaccgatgcctctcctggcgcgacaacgagacttcagcggagttcagcttcgtaggggaatctacaaccatgcgtgagaacaagtgcttcgaacaatgcggaggctggggatgcggttgcttcaacgtcaacccatcctgcctattcgtacatacttacctccagtccgtcagaaaagaggcgctacgcgtcttcaactgtatagactgggttcacaaacttaccctggaaataaccgacttcgacggatccgtcagcacaatagatctgggagcttccagctcacgtttcacgaactgggggtccgtctcgctttctctagacgccgaaggcataagcggctccaactccttctccttcatcgaaagccccggcaaaggctacgccatcgtagacgagccattctcagagatcccccgccaaggcttcctcggcgagatcagatgtaacagcgaatcctccgtactctcagcacacgaatcctgccttcgcgcaccaaatcttatctcctacaaacccatgatcgaccaactagaatgtaccaccaatctaatagatcccttcgtagtattcgaacgcggctctctaccccaaacacgcaacgacaaaacattcgcggcctccaaagggaaccggggcgtgcaagccttctccaaaggaagtgtccaagccgatctcacactcatgttcgacaactttgaagtagacttcgtcggggcggccgtaagttgcgatgcggccttcctaaacctgaccggctgttactcatgcaacgcgggcgccagagtctgcctctccataacctccaccggaaccggatcactgtcagcacacaacaaagacggatccctacacatcgtccttccatccgaaaatggcacaaaagaccaatgccaaatcttacacttcaccgtcccagaagtagaagaagagttcatgtacagttgcgacggagatgagcgcccgttactcgtaaagggcacacttatagccattgacccgttcgacgacagacgtgaggccggaggagaaagcaccgtcgtaaatccaaagtcagggtcatggaacttcttcgactggttttccggattaatgtcctggttcggaggccctctcaaaactatactcctaatatgcctatacgtcgccctctccatcggcctattcttcctcctaatatacctcggacgcacaggcctctccaaaatgtggctagccgccaccaaaaaggcctcctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17419 - RNA, 3337 nt, synthetic construct
  misc_feature 1..3337: note = mRNA product Design2 comprising derived and/or modified sequence from RVFV(ZH-548)__DQ380206.1__Gne_SP-Gn_Gc (opt11)
  source 1..3337: mol_type = other RNA
ggggcgctgcctacggaggtggcagccatctccttctcggcatcaagcttaccatggcaggaatcgccatgacagtcctaccagcacttgccgtatttgccctcgccccagtagtatttgccgaagacccacacctcagaaaccgacccggaaaaggacacaactatatcgatggcatgacccaggaagatgcaacatgcaaacctgtaacctacgccggcgcatgctccagcttcgacgtactacttgagaaaggcaaatttccactctttcaatcttacgctcaccaccgcacccttctagaggccgtccacgacacgatcatagctaaagccgacccaccaagctgcgacctcctctcagcccatggcaacccatgcatgaaagagaaactcgtaatgaaaacccactgccccaacgactaccagtccgctcactacctcaataacgacggaaaaatggcctcagtcaaatgcccacccaaatacgagcttacagaggactgcaacttctgccgccaaatgaccggagcctcactcaagaaaggaagctacccccttcaggacctattctgccagagctcagaagacgacggtagcaagctaaaaaccaaaatgaaaggggtttgcgaggtcggcgtccaggcgctcaagaaatgcgacggtcaactctctacagcacatgaagtcgtacccttcgccgttttcaaaaacagcaagaaagtctacctcgacaaactagacctcaaaaccgaagaaaacctactccccgacagcttcgtgtgcttcgaacacaaaggccaatataaaggcacgatggactccggacagaccaaaagggaactaaaatccttcgacatatcccaatgccccaaaatcggaggccacggatccaagaaatgcaccggagacgccgccttctgctcagcatacgaatgcacagcacaatacgccaacgcatactgcagccacgcaaacggatccggaatagtgcagatccaagtaagcggagtctggaagaaacccctctgtgtcggctacgaacgcgtggtcgtaaaaagagagctttcagctaaaccaatacaacgagtagaaccctgcaccacgtgcattacaaaatgcgaaccacacggcctcgtcgttcgcagcactggtttcaaaatatctagcgcggtagcatgcgcctcaggcgtatgcgtgaccggatcccagtcaccatcaacagaaatcaccctcaaatacccgggcatttcacaatcatcaggtggcgacatcggggtacacatggcacacgacgatcaatccgtctcttcaaaaatcgtcgcccactgcccaccccaggacccctgtttagtgcacgactgtatagtctgcgcccacggcctaattaactaccaatgccacaccgccatggccggaatcgcaatgacagtcttaccggccctcgcagtattcgccctagccccagttgtcttcgcagaagactgctcagaactaatccaagcctcttcccgaatcaccacatgcagcaccgaaggcgtcaacacaaaatgccgcctctcgggcaccgccctcatacgcgcaggcagcgtcggcgccgaagcgtgcctaatgcttaaaggagtcaaagaagatcaaaccaaatttctaaaaatcaaaactgtgagctcagaactctcatgcagagaaggacaaagctactggaccggatcattttctcctaaatgcctgagctctcgcagatgccacctcgtaggagagtgccatgtcaaccgctgtctctcttggcgagacaacgagacctccgcagagttcagcttcgtaggtgaatcaacaaccatgcgagaaaacaaatgcttcgaacaatgcggtggctggggttgcggatgcttcaacgtcaacccctcatgtctcttcgtccacacatacctccaaagcgttcgcaaagaagctctacgcgtattcaattgcattgattgggtacataagctcacactagaaatcacggactttgacggctcagtctcaaccatcgatctcggtgcatccagttcgcgcttcactaactggggaagcgtctcgctttccctcgatgccgaaggcatatccggatcgaactcattctcgttcattgaatcacccggcaaaggctacgccatcgtagatgaacccttcagtgaaatcccgagacaaggattcctaggagaaatccggtgcaactccgaatcgagcgtcctctccgcacacgaatcctgcctccgcgcccctaatctcatctcctacaaaccaatgatcgatcaactcgaatgtacaacaaacctgatcgatcccttcgtcgtgtttgaacgtggctcactcccccaaacccgcaatgacaaaacgttcgccgcttctaaaggcaaccggggcgtccaggctttcagcaagggctccgtccaagccgacctcacgctcatgttcgacaacttcgaagtcgacttcgtcggagccgctgtttcctgtgacgccgcatttctaaacttaaccgggtgctacagctgcaatgccggcgcaagagtatgcctctccatcacctcaaccggaactggctccctaagcgcccacaacaaagacggctcactccacatcgtcctaccaagcgaaaacggcacgaaagaccaatgccaaatcctgcactttaccgtacccgaagtcgaagaggagttcatgtatagctgcgacggcgacgaacgaccacttctagtcaaaggcacactcatcgccatcgaccccttcgacgaccgcagagaagcaggcggtgaatcaactgtggtaaaccccaaatcaggcagctggaacttcttcgactggttctccggactcatgagctggttcggcggcccccttaagaccatcttactcatctgcctatacgtcgcactatccatcggactcttctttctactcatctacctcggccgcacaggcctctctaaaatgtggctagccgcaaccaagaaagcaagttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17420 - RNA, 3571 nt, synthetic construct
  misc_feature 1..3571: note = mRNA product Design2 comprising derived and/or modified sequence from RVFV(ZH-548)__DQ380206.1__IgE-leader_Gn(delSP)-Gc-variant1 (opt11)
  source 1..3571: mol_type = other RNA
ggggcgctgcctacggaggtggcagccatctccttctcggcatcaagcttaccatggactggacctggatactgttcctcgtagccgccgctacccgcgtccatagtgaagacccacacctaagaaaccgccccggaaaagggcacaactacatagatggtatgacacaagaggacgcgacgtgtaaacccgtaacctatgctggagcttgtagctcctttgatgtccttctcgagaaaggaaaattccccctcttccaatcctacgcccaccacagaaccctactcgaggcagtgcatgacacaataatcgctaaagcagacccaccatcttgcgatctattatctgctcacggaaacccctgcatgaaagaaaagctagtcatgaaaacccactgccccaacgattaccaatcagcacattaccttaataacgacggcaaaatggcctccgtcaaatgtcccccaaaatacgaactcacagaggattgcaacttctgccgccagatgaccggcgcctccctcaagaaagggtcctaccctctccaagacctattctgccaatcctccgaagacgacggctccaaattaaaaacgaaaatgaaaggcgtctgcgaagtgggcgttcaagctctcaagaaatgcgacggtcaactatccaccgcacacgaagtcgttcccttcgcagtcttcaaaaattctaagaaagtctacctagacaaacttgacctaaaaaccgaagagaatctcctacccgactccttcgtctgcttcgaacacaaaggacaatacaaaggcaccatggattccggccaaacaaaacgcgaactcaaatccttcgacatctcacaatgtcccaaaataggaggtcacggatcgaagaaatgcaccggagacgctgccttctgctctgcatacgaatgcaccgcccaatatgccaacgcctactgttcacacgccaacggctccggcatagtccaaatacaagtctcgggcgtatggaagaaacccctctgcgtaggctacgagcgagtggtagtcaaaagagaactctccgccaaaccgatccaacgcgtcgagccatgcacaacgtgtattacaaaatgcgaaccacacgggctagttgtccggtcgaccgggttcaaaatctcttcagccgtagcctgcgcctcaggtgtatgcgtcaccggatcacaatccccgagcaccgaaataaccctaaaatacccggggatcagccagtcgtccggcggcgatatcggcgttcacatggcgcacgacgaccagagcgtcagcagcaaaatcgtcgcccactgtcctccccaagacccctgcctggtacacgactgcatcgtctgcgctcacggcctcataaactaccagtgccataccgccctgtccgccttcgttgtcgtattcgtcttctcctcaatcgccatcatctgcctagccatactataccgcgtactcaaatgtctaaaaatcgcaccccgcaaagtacttaaccctctaatgtggatcaccgcattcatccgctggatctataagaaaatggtagcccgggtcgccgacaacatcaaccaagtcaaccgtgaaatcggatggatggaaggcggacaactcgtcctgggcaaccccgccccaatcccgcgacacgccccaatccctcgctactccacctacctcatgctactactcatcgtaagctacgcttccgcatgctccgagctaatccaggcttcctcccgcatcacaacttgttcaacagagggcgtaaacacaaaatgtagactgtctggcacagccctaatacgtgcaggaagcgtaggagccgaagcctgcctcatgcttaaaggagtaaaagaagaccaaacgaaatttctcaaaatcaaaacagtcagttccgagctctcatgccgcgaaggccaatcctactggaccggcagtttctcccccaaatgcctaagcagtcgccgctgccacctcgtcggcgaatgccacgtaaatcgatgtttgtcatggcgagataatgaaacctccgcagagttttcatttgtaggcgaatccaccaccatgcgcgaaaacaaatgcttcgaacaatgcggaggttggggctgcggctgcttcaacgtgaacccgtcatgcctcttcgttcacacctatcttcaatccgtgcgcaaagaagcactccgcgtgtttaattgcatcgactgggtccacaaacttacccttgaaataactgacttcgacggctccgtctccacaatagacttaggagcctcatcatcaagattcaccaattggggatcagtttccctctcgctcgacgctgaaggtataagtggcagtaactcattctcattcatcgaatcacccggcaaaggctatgctatcgtagatgagcccttttccgagatcccacgacaaggatttctaggggaaattcgctgtaattcggagtcctccgtcctatcggcccacgaatcatgcctccgcgccccaaacctcatctcgtacaaacccatgatcgaccagttggaatgcaccacaaacctcattgaccccttcgtggtcttcgaacgaggaagcctcccccaaacacgcaacgacaaaaccttcgccgcctcgaagggcaaccgcggcgtacaagccttcagtaaaggatcggtccaagcagaccttaccctcatgttcgacaacttcgaggtcgacttcgttggagcggcggtgtcctgcgatgccgcattcctcaacctcacaggctgctactcctgcaacgctggagcacgcgtatgcttatcaataacctctactggaactggctcactatccgcccacaacaaggacggcagcctccacatcgtcctcccatcagaaaacggcacaaaagatcagtgccaaatactccactttacggtcccggaggtcgaagaagagttcatgtacagctgcgacggcgacgaacgccccctcctagtaaaaggtaccctgatagcaatcgaccccttcgatgaccgccgagaggccggcggggaatccacagtggtcaacccgaaatccggcagctggaacttcttcgactggttctccgggcttatgtcctggttcggcggccctctcaaaacgatactactaatctgcctatacgtcgcgctgtccataggcttattcttcctactaatataccttgggcgcactggcctctcaaagatgtggctggccgccaccaagaaggcctcctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17421 - RNA, 3565 nt, synthetic construct
  misc_feature 1..3565: note = mRNA product Design2 comprising derived and/or modified sequence from RVFV(ZH-548)__DQ380206.1__IgE-leader_Gn(delSP)-Gc-variant2 (opt11)
  source 1..3565: mol_type = other RNA
ggggcgctgcctacggaggtggcagccatctccttctcggcatcaagcttaccatggattggacgtggatcctgtttctcgtggccgccgcgaccagagtccacagcccacatctcagaaaccgcccgggcaagggacacaactacatagacggcatgacccaggaggacgcgacctgcaagcccgtgacctacgccggcgcctgtagcagcttcgacgtactgctggagaagggcaaattccccctgttccagtcctacgcacaccaccggacactgctcgaggcggtccatgacacaatcatagctaaggccgaccctccctcgtgcgaccttctatccgcgcacgggaatccctgcatgaaggagaagctcgtcatgaagacccactgtcccaacgactaccagagcgcccactacctgaacaacgacggcaaaatggcctctgtgaagtgccctcccaaatacgagctcacagaggattgcaacttctgcaggcagatgactggcgcctcgttaaagaaagggtcttaccctctgcaggacctgttctgccagagctccgaagacgacggaagcaagctcaagacgaagatgaagggcgtctgcgaggtgggcgtgcaggccctgaagaaatgcgacgggcagctgtccactgcccacgaggtcgtaccattcgcggtgttcaaaaacagcaagaaagtctacttggacaagctggatcttaagaccgaggagaacctactccccgactcttttgtgtgcttcgagcataaggggcagtataagggcacgatggacagtggacagacaaagcgagagctgaaaagtttcgacattagccagtgcccgaaaatcggcggtcacggctccaagaagtgcaccggcgacgccgccttctgctccgcctacgagtgtactgcccagtacgcgaacgcctactgcagccacgcaaatgggagtggcatagtgcagatccaggtcagcggggtatggaagaagccactatgcgtgggctacgagcgcgtggtggtgaagcgggaactgtccgctaagcccatccagcgcgtcgagccctgcaccacttgcatcaccaagtgcgagccccacgggctggtggtccggagcaccggtttcaaaatttccagcgccgtcgcgtgcgcgtccggtgtgtgcgtcaccgggagccagtcccccagcacggagatcaccctcaagtaccccggcatctcccagagctccgggggcgacatcggggtgcacatggcccacgacgaccaatctgtgtcctcaaagatcgtggcccactgccctccccaggacccctgcctggtgcacgactgcatcgtgtgcgcccacggcctgataaactaccagtgccacacggcgctcagcgcgtttgttgtagtgttcgtcttcagctccatcgccatcatctgcctagccattctgtaccgggtgctcaagtgcctgaagatcgctccccggaaagtgctgaatcctctgatgtggatcaccgccttcatccggtggatctacaagaagatggtggcccgggttgccgacaacatcaaccaagtgaaccgcgagatcggctggatggagggcgggcagctggtcctggggaacccggcccccatcccccgacacgcgcccatcccccgctactctacgtacctcatgctgctgctcatcgtgtcgtacgcctctgcatgcagcgagttgatccaggcgtccagcaggatcacaacctgcagcaccgagggcgtcaacacgaagtgccgcctgagtggaaccgccctcatccgggcgggctccgttggcgctgaggcctgcctgatgttaaagggggtaaaggaagaccaaaccaaattcttgaagatcaagaccgtcagctccgaactgagctgccgagaaggccagtcctactggacggggtctttcagtcccaagtgcctgagctcccgacgctgccatctcgtcggtgagtgccacgtcaaccgctgcctctcatggcgggacaacgagacatccgccgagttctcatttgtgggcgagtccaccaccatgcgcgagaacaagtgctttgagcagtgcggtggctggggctgcggatgcttcaacgtcaacccctcctgcctgttcgtccatacgtacctgcagagcgtgcggaaggaggccctcagggtcttcaactgcatcgactgggtgcacaagctgaccctggagatcaccgacttcgacggctctgtgtccaccattgacttgggcgcgtccagcagcagatttacgaactggggcagcgtcagtctcagcctggacgccgaggggatctccggcagtaactccttctcgttcatcgagtccccggggaagggctacgccatcgtagacgagcccttctcagagatcccccgccaggggtttctcggcgagattcgctgcaactccgaaagctcagttttgagcgcccacgaaagctgtctgcgcgcgcctaacctcatctcctacaagcccatgatcgaccagctggagtgcacgaccaacctgatcgaccccttcgtggtcttcgagcggggcagcctcccccagacccgcaacgacaagaccttcgccgcctcaaaagggaacaggggcgtgcaagccttctcaaaggggtccgtacaagccgaccttacgctgatgttcgacaactttgaggttgacttcgtgggcgcggccgttagctgcgacgccgcgtttctcaacctgaccggatgttacagttgcaatgcgggggcacgcgtctgcctttctatcaccagcaccggcacggggagcctctccgcccacaacaaggacggctcgctacacatcgtattaccgagcgagaacgggaccaaggaccagtgccagattctccacttcaccgtaccggaggtggaggaggagttcatgtactcctgcgacggtgacgaacggcccctactggtaaaagggaccctaatcgccatcgaccccttcgacgaccgccgcgaggcgggcggcgagtccacggtcgtgaaccccaaaagcgggtcctggaacttcttcgactggttcagcggcctgatgagctggttcgggggcccgttaaagactatcctccttatttgcctgtatgtggcgctcagcatcggcctgttctttttattaatatacctggggcgcaccggcctgagcaagatgtggctcgcggctacaaagaaggcctcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17422 - RNA, 2050 nt, synthetic construct
  misc_feature 1..2050: note = mRNA product Design2 comprising derived and/or modified sequence from RVFV(ZH-548)__DQ380206.1__IgE-leader_Gn(delSP)-variant1 (opt11)
  source 1..2050: mol_type = other RNA
ggggcgctgcctacggaggtggcagccatctccttctcggcatcaagcttaccatggactggacctggatcctcttcctagtcgccgcagccacccgcgtccactccgaagacccacacctacggaaccgcccaggaaaaggacacaactacattgacggcatgacccaagaggacgcaacctgcaaaccagtaacatacgccggcgcctgctcctccttcgacgtcctcctagaaaaaggcaaattcccactattccaatcctacgcccaccaccgaacactgctcgaagccgtacacgacaccatcatagcaaaagccgacccaccttcctgcgacctcctctccgcccacggcaacccctgcatgaaggaaaaactcgtcatgaagacccactgccccaacgactaccagagcgcccactacctcaacaacgacggcaagatggctagcgtcaagtgtcccccaaaatacgaactcactgaagactgcaacttctgccgccaaatgacaggggcatctctcaagaaaggctcctacccactccaagacctgttctgccaatcaagcgaagacgacggatccaaactcaaaaccaaaatgaaaggagtctgcgaagttggcgtccaagccctcaagaaatgcgatggccaactatcaacagctcacgaagtcgtccccttcgccgtcttcaaaaactctaagaaagtctacctcgacaaactcgacctcaaaaccgaagaaaacctactccccgattcattcgtctgcttcgaacacaaaggccagtacaaaggaaccatggactcaggccaaacaaaacgcgaactaaaatcattcgacatctcacaatgcccaaaaatcggtggacacggctcaaagaaatgcaccggagatgcggccttctgcagcgcctacgaatgcaccgctcaatatgcaaacgcctactgctcccacgccaacggctcaggaatcgtccagatccaagtatccggagtctggaagaaacccctatgcgtcggctacgaacgcgtagtagtaaaacgagaactctccgccaaacctatacaacgcgtagaaccctgcacaacatgcataacaaaatgcgagccccacggcctagtcgtccgctccaccggattcaaaatttcctctgcagtcgcatgcgcctcaggagtctgcgtcacaggctcacaatcgccctcaaccgaaatcactctcaaatacccaggcatcagccaaagctccggcggagacatcggagtccacatggcccacgacgaccaatccgtctccagcaaaatagtggcacactgccctccacaggatccctgcctcgttcacgactgcatcgtctgcgcccacggcctcataaactaccaatgccacaccgccctctccgcgttcgtcgtcgttttcgtattctcgtccatcgcaatcatctgccttgcaatcctctaccgggtcctcaaatgtctaaaaatcgcaccccgaaaagtcctcaaccctctaatgtggataacagccttcataagatggatctacaagaaaatggtcgcccgcgtagccgacaacatcaaccaggtcaaccgagaaatcggctggatggaaggaggccaactcgtcctcggcaacccagcccctatcccacgacacgcacccatcccccgctactccacctacctcatgctcctactcatagtatcctacgcctccgcctagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17423 - RNA, 2044 nt, synthetic construct
  misc_feature 1..2044: note = mRNA product Design2 comprising derived and/or modified sequence from RVFV(ZH-548)__DQ380206.1__IgE-leader_Gn(delSP)-variant2 (opt11)
  source 1..2044: mol_type = other RNA
ggggcgctgcctacggaggtggcagccatctccttctcggcatcaagcttaccatggactggacctggatcctcttcctcgtcgctgcagcaacacgcgtccactcgccacaccttcgcaacagaccaggcaaaggccacaactacatagacggaatgacacaagaagacgcaacctgcaaacccgtcacatacgccggcgcatgctcatccttcgacgtcctactagaaaagggcaaattccccctattccaatcctacgcccaccaccgaaccctcctagaagccgtccacgacaccatcatagcaaaggccgatcctccctcctgcgacctgctgtcagcacacggcaatccctgcatgaaagaaaagctagtcatgaaaacacactgccccaacgactaccaaagcgcccactatctcaacaacgacggcaaaatggcatcagtcaaatgcccacccaaatacgaactgaccgaagactgtaacttctgccgccaaatgaccggcgcctctctcaagaaaggatcataccccctccaagacctattctgccaatccagtgaagacgacggatccaaactcaaaaccaaaatgaaaggcgtctgcgaagttggagtgcaggccctcaagaaatgcgacggccaactttccaccgcccatgaggtagtacccttcgccgtattcaaaaactcgaagaaagtatacctagacaaactcgacttaaaaaccgaagaaaacctcctccccgactcattcgtctgcttcgaacacaaaggccaatacaaaggcaccatggactccggacaaaccaaacgcgaactcaaatccttcgacatcagccaatgtcccaaaataggaggacacggcagcaagaaatgcaccggcgacgccgcattttgctcagcctacgaatgcacagcacaatacgcaaacgcatactgctcacacgcaaacggctccggaatcgtccaaatccaagtatccggtgtttggaagaaacccctctgcgtcggatacgaacgcgtcgttgtcaaaagagaactctcagccaaaccaatccaacgcgtcgaaccctgcacaacctgcatcaccaaatgcgaacctcacgggctagtcgtccgatccaccggtttcaaaatctcaagcgccgtcgcctgtgccagcggtgtatgcgtaaccggatcccaatctccatcaaccgaaatcactctaaaataccccggaataagccagtcctccggaggagacataggcgtccacatggcacacgacgaccaatcagtctcatccaaaatagtagcacactgcccgccacaagacccatgcctagtccacgattgcatcgtctgcgcccacggcctaatcaactatcaatgccacaccgcactcagcgcattcgtggtcgtcttcgtcttctccagcatcgcaatcatatgcctcgccatcctctaccgcgtactcaaatgcctaaaaatagcccctcgaaaagttctcaaccccctcatgtggatcaccgcttttatccgatggatctacaagaaaatggtagctcgagtcgccgataacatcaaccaagtaaaccgcgaaatcggatggatggaaggcggccaactcgtcctaggaaatccggcccccatacctagacacgcacccatccctcgctactcaacctaccttatgctactccttatagtatcttacgcatccgcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17424 - RNA, 1960 nt, synthetic construct
  misc_feature 1..1960: note = mRNA product Design2 comprising derived and/or modified sequence from RVFV(ZH-548)__DQ380206.1__IgE-leader_Gc (opt11)
  source 1..1960: mol_type = other RNA
ggggcgctgcctacggaggtggcagccatctccttctcggcatcaagcttaccatggactggacatggatcctcttcctcgtggccgcagccacaagagtccactcgtgctccgaacttatccaagcctccagccgaatcacaacctgcagcaccgaaggcgtaaataccaaatgccgactctccggcaccgccctaatccgcgcaggctcagtaggcgccgaagcctgccttatgctcaaaggagtcaaagaagaccaaaccaaattcctcaaaatcaagaccgtaagcagcgaactaagctgccgagaaggccagagctattggacaggctcattctcacccaaatgcctcagttcccgcagatgccacctagtcggcgaatgccacgtcaaccggtgcctctcatggcgggacaacgaaaccagcgcggaatttagcttcgtaggagaatcaactaccatgcgagaaaataagtgcttcgagcaatgcggcggctggggatgcggctgcttcaacgtaaacccctcatgcctattcgtccacacatacctccaatccgtccgcaaggaagccctacgcgtctttaactgcattgactgggtgcacaaacttacactcgaaatcacggacttcgacggcagcgtcagcacaatagacctcggcgcctccagctcccgcttcaccaattggggctccgtaagcctctccctggacgcagaaggcatctcaggctccaattcgttctccttcatagaatcacctgggaaaggctacgccatcgtagacgaacccttcagcgaaattccacgccaaggcttcctaggagaaatccgctgcaactctgaatcaagcgtactctccgcccacgaatcctgtctacgcgcccccaatctaatcagctacaaacccatgattgaccaactcgaatgcacaaccaatttaatcgacccatttgtcgtcttcgagcgcggatcactaccacaaacccgaaacgacaaaaccttcgcagcaagcaagggaaaccgcggtgtacaagccttcagcaaaggctccgtccaagcagaccttacactaatgttcgacaacttcgaagtcgacttcgtcggcgccgccgtcagctgcgacgccgccttcctgaacctcacgggctgttacagctgcaacgccggcgcacgcgtctgcctatctatcacctcgaccggcacaggatcactatccgcacacaacaaagacggatcgctccacatcgtactcccaagcgaaaacggcaccaaggaccagtgccaaatcctgcacttcaccgtaccagaagtagaagaagagttcatgtactcatgcgacggcgacgaaagaccactgctcgtgaaaggcacccttatagcgatcgacccattcgacgaccgacgagaagcaggaggcgaatcaacagttgtaaaccccaaaagcggaagttggaacttcttcgactggttcagcgggctcatgagctggttcggaggaccactcaaaaccatactcctcatctgcctctacgtcgcactcagcatcgggcttttcttcctcctcatctacctgggccgcaccggactatcaaaaatgtggctcgccgccaccaagaaagcaagctaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17425 - protein, 245 aa, synthetic construct; identical to SEQ ID NO: 877
  REGION 1..245: note = derived and/or modified protein sequence (wt) from SFTSV(HB29)__NC_018137.1__N

SEQ ID NO: 17426 - protein, 1073 aa, synthetic construct; identical to SEQ ID NO: 2357
  REGION 1..1073: note = derived and/or modified protein sequence (wt) from SFTSV(HB29)__NC_018138.1__GP

SEQ ID NO: 17427 - protein, 1072 aa, synthetic construct
  REGION 1..1072: note = derived and/or modified protein sequence (wt) from SFTSV(HB29)__NC_018138.1__IgE-leader_Gn-Gc
MDWTWILFLVAAATRVHSDSGPIICAGPIHSNKSAGIPHLLGYSEKICQIDRLIHVSSWLRNHSQFQGYVGQRGGRSQVSYYPAENSYSRWSGLLSPCDADWLGMLVVKKAKESDMIVPGPSYKGKVFFERPTFDGYVGWGCGSGKSRTESGELCSSDSGTSSGLLPSDRVLWIGDVACQPMTPIPEETFLELKSFSQSEFPDICKIDGIVFNQCEGESLPQPFDVAWMDVGHSHKIIMREHKTKWVQESSSKDFVCYKEGTGPCSESEEKACKTSGSCRGDMQFCKVAGCEHGEEASEAKCRCSLVHKPGEVVVSYGGTRVRPKCYGFSRMMATLEVNPPEQRIGQCTGCHLECINGGVRLITLTSELRSATVCASHFCSSASSGKKSTEIHFHSGSLVGKTAIHVKGALVDGTEFTFEGSCMFPDGCDAVDCTFCREFLKNPQCYPAKKWLFIIIVILLGYAGLMLLTNVLKAIGVWGSWVIAPVKLMFAIIKKLMRTVSCLVGKLMDRGRQVIHEEIGENGEGNQDDVRIEMARPRRVRHWMYSPVILTILAIGLAEGCDEMVHADSKLVSCRQGSGNMKECITTGRALLPAVNPGQEACLHFTAPGSPDSKCLKIKVKRINLKCKKSSSYFVPDARSRCTSVRRCRWAGDCQSGCPPHFTSNSFSDDWAGKMDRAGLGFSGCSDGCGGAACGCFNAAPSCIFWRKWVENPHGIIWKVSPCAAWVPSAVIELTMPSGEVRTFHPMSGIPTQVFKGVSVTYLGSDMEVSGLTDLCEIEELKSKKLALAPCNQAGMGVVGKVGEIQCSSEESARTIKKDGCIWNADLVGIELRVDDAVCYSKITSVEAVANYSAIPTTIGGLRFERSHDSQGKISGSPLDITAIRGSFSVNYRGLRLSLSEITATCTGEVTNVSGCYSCMTGAKVSIKLHSSKNSTAHVRCKGDETAFSVLEGVHSYIVRLSFDHAVVDEQCQLNCGGHESQVTLKGNLIFLDVPKFVDGSYMQTYHSTVPTGANIPSPTDWLNALFGNGLSRWILGVIGVLLGGLALFFLIMFLLKLGTKQVFRSRTKLA

SEQ ID NO: 17428 - RNA, 738 nt, synthetic construct; identical to SEQ ID NO: 3212
  misc_feature 1..738: note = derived and/or modified CDS sequence (wt) from SFTSV(HB29)__NC_018137.1__N
  source 1..738: mol_type = other RNA

SEQ ID NO: 17429 - RNA, 3222 nt, synthetic construct; identical to SEQ ID NO: 4692
  misc_feature 1..3222: note = derived and/or modified CDS sequence (wt) from SFTSV(HB29)__NC_018138.1__GP
  source 1..3222: mol_type = other RNA

SEQ ID NO: 17430 - RNA, 3222 nt, synthetic construct
  misc_feature 1..3222: note = derived and/or modified CDS sequence (wt) from SFTSV(HB29)__NC_018138.1__GP
  source 1..3222: mol_type = other RNA
atgatgaaagtcatctggttctcctctctgatctgcttagtcattcaatgcagtggggattcgggcccaatcatctgcgcaggacccatccactcaaacaagagtgctggcataccccacctccttggttactctgagaagatttgtcagatagatcggctgatacatgtttcgtcatggctcaggaaccactcgcaatttcaaggctacgttgggcagcgaggtggacgctctcaggttagctactacccagctgagaactcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgagttcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgagttcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagaactcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattacaagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 17431 - RNA, 3219 nt, synthetic construct
  misc_feature 1..3219: note = derived and/or modified CDS sequence (wt) from SFTSV(HB29)__NC_018138.1__IgE-leader_Gn-Gc
  source 1..3219: mol_type = other RNA
atggactggacctggatcctgttcctcgtggccgccgcgacccgcgtccacagcgattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 17432 - RNA, 3219 nt, synthetic construct
  misc_feature 1..3219: note = derived and/or modified CDS sequence (wt) from SFTSV(HB29)__NC_018138.1__IgE-leader_Gn-Gc
  source 1..3219: mol_type = other RNA
atggactggacctggatcctgttcctcgtggccgccgcgacccgcgtccacagcgattcgggcccaatcatctgcgcaggacccatccactcaaacaagagtgctggcataccccacctccttggttactctgagaagatttgtcagatagatcggctgatacatgtttcgtcatggctcaggaaccactcgcaatttcaaggctacgttgggcagcgaggtggacgctctcaggttagctactacccagctgagaactcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgagttcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgagttcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagaactcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattacaagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttag

SEQ ID NO: 17433 - RNA, 738 nt, synthetic construct; identical to SEQ ID NO: 5547
  misc_feature 1..738: note = derived and/or modified CDS sequence (opt4) from SFTSV(HB29)__NC_018137.1__N
  source 1..738: mol_type = other RNA

SEQ ID NO: 17434 - RNA, 3222 nt, synthetic construct; identical to SEQ ID NO: 9795
  misc_feature 1..3222: note = derived and/or modified CDS sequence (opt4) from SFTSV(HB29)__NC_018138.1__GP
  source 1..3222: mol_type = other RNA

SEQ ID NO: 17435 - RNA, 3219 nt, synthetic construct
  misc_feature 1..3219: note = derived and/or modified CDS sequence (opt4) from SFTSV(HB29)__NC_018138.1__IgE-leader_Gn-Gc
  source 1..3219: mol_type = other RNA
atggactggacctggatcctgttcctggtggccgccgccaccagagtgcacagcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcaccagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagactgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctga

SEQ ID NO: 17436 - RNA, 738 nt, synthetic construct; identical to SEQ ID NO: 6239
  misc_feature 1..738: note = derived and/or modified CDS sequence (opt3) from SFTSV(HB29)__NC_018137.1__N
  source 1..738: mol_type = other RNA

SEQ ID NO: 17437 - RNA, 3222 nt, synthetic construct; identical to SEQ ID NO: 11438
  misc_feature 1..3222: note = derived and/or modified CDS sequence (opt3) from SFTSV(HB29)__NC_018138.1__GP
  source 1..3222: mol_type = other RNA

SEQ ID NO: 17438 - RNA, 3219 nt, synthetic construct
  misc_feature 1..3219: note = derived and/or modified CDS sequence (opt3) from SFTSV(HB29)__NC_018138.1__IgE-leader_Gn-Gc
  source 1..3219: mol_type = other RNA
atggactggacctggatcctgttcctcgtggccgctgcaacaagagtccacagcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggacaagggtgcggcccaaatgttacggcttcagtcgcatgatggccaccctggaggtcaaccctccagaacagcgaatcggacaatgcactggctgtcaccttgagtgcatcaatgggggagtgagattgattacactgaccagcgagctaaggtccgctacggtttgtgcctctcatttttgctcgagcgcgtcctcaggtaagaagagtactgaaatacacttccactctggcagcctcgtggggaaaaccgcaatccatgtcaagggagccctggtggacggcacagagttcacttttgaaggttcctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcatgggtgatcgcccccgtcaaacttatgttcgcgattatcaagaagctgatgcgtaccgtgagctgtttggttggaaaactaatggaccgcggtagacaggtgattcacgaagagataggcgagaacggggaaggaaatcaagatgacgtaaggatcgagatggcccggccacgacgcgtcagacattggatgtattctcctgtgattctgacgatcctcgcaatcggcctggctgaaggttgcgatgagatggttcacgccgactccaaacttgtgagttgtaggcaggggagcggcaacatgaaggagtgcattactacaggacgggctctgttgcccgccgtcaatccaggccaggaagcatgtctccattttaccgcccccgggtctcctgattccaagtgcctgaagataaaagtgaagcgcatcaacttaaaatgtaagaaatcaagtagctacttcgtaccagacgctagatcgaggtgcacttccgtgcgtcggtgtcgatgggcgggagattgccagtctggctgcccgccccactttacaagcaattcattcagtgacgactgggcaggtaagatggatagagccgggctgggattttccggctgttctgacggttgcggcggggctgcctgtggatgcttcaacgcagcccctagctgtatcttttggaggaagtgggttgagaatccacacggcattatttggaaagtctccccctgcgctgcctgggtgccttcagcagtgatcgaactaaccatgccaagcggggaggtccgcacgttccatcccatgagtggaataccgacccaagttttcaagggcgtgtctgtgacatatctcggttccgatatggaagtaagcgggctgactgacctttgtgagatcgaggaattgaaatcgaagaaactggcgctcgctccttgcaaccaggccggaatgggcgtcgtgggtaaggttggcgagattcagtgttcatctgaagagagtgcacggaccatcaaaaaggatgggtgcatttggaacgccgacctggtgggaatcgaacttagagtcgatgacgctgtgtgttactccaagataacaagcgttgaggccgtggcaaattattctgctattccaactaccatcggcgggctgaggtttgagcgcagccacgattcccagggaaaaatttcaggcagtcccttggacatcacagccatacgaggtagcttctctgtaaactaccgggggctccgtctgtccttatcagaaatcaccgcgacttgcacgggagaggtcacaaatgtgagtggctgctacagctgtatgaccggtgccaaggtgtccattaaactgcattcttcgaagaacagcactgctcacgtcagatgcaaaggcgatgaaaccgcattttcagttctagagggggtgcactcctatatcgtaaggctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaaactgggaaccaagcaagtgtttcggagcagaactaaacttgcgtga

SEQ ID NO: 17439 - RNA, 738 nt, synthetic construct; identical to SEQ ID NO: 6931
  misc_feature 1..738: note = derived and/or modified CDS sequence (opt1) from SFTSV(HB29)__NC_018137.1__N
  source 1..738: mol_type = other RNA

SEQ ID NO: 17440 - RNA, 3222 nt, synthetic construct; identical to SEQ ID NO: 13081
  misc_feature 1..3222: note = derived and/or modified CDS sequence (opt1) from SFTSV(HB29)__NC_018138.1__GP
  source 1..3222: mol_type = other RNA

SEQ ID NO: 17441 - RNA, 3219 nt, synthetic construct
  misc_feature 1..3219: note = derived and/or modified CDS sequence (opt1) from SFTSV(HB29)__NC_018138.1__IgE-leader_Gn-Gc
  source 1..3219: mol_type = other RNA
atggactggacctggatcctgttcctcgtggccgccgcgacccgcgtccacagcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcacccgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccagctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcatcacgaccggccgcgccctgctgcccgccgtgaaccccgggcaggaggcctgcctccacttcaccgcccccggcagcccggacagcaagtgcctgaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccacgaccatcggcggcctccgcttcgagcggagccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacatcgtgcggctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctga

SEQ ID NO: 17442 - RNA, 738 nt, synthetic construct; identical to SEQ ID NO: 7623
  misc_feature 1..738: note = derived and/or modified CDS sequence (opt5) from SFTSV(HB29)__NC_018137.1__N
  source 1..738: mol_type = other RNA

SEQ ID NO: 17443 - RNA, 3222 nt, synthetic construct; identical to SEQ ID NO: 14724
  misc_feature 1..3222: note = derived and/or modified CDS sequence (opt5) from SFTSV(HB29)__NC_018138.1__GP
  source 1..3222: mol_type = other RNA

SEQ ID NO: 17444 - RNA, 3219 nt, synthetic construct
  misc_feature 1..3219: note = derived and/or modified CDS sequence (opt5) from SFTSV(HB29)__NC_018138.1__IgE-leader_Gn-Gc
  source 1..3219: mol_type = other RNA
atggactggacctggatcctgttcctcgtggccgctgccacaagagtccacagcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaggcttctgaagccaaatgtcggtgctccctggtgcataagcctggggaagtggtcgtgagctacggaggcacacgcgttagacccaaatgttacgggttctcccggatgatggcgacccttgaggtgaaccctcccgaacagcgcatcggacaatgcacgggctgtcacctggagtgcattaatgggggcgtcagactcatcaccctgacatctgagctgcggagcgccaccgtgtgtgcttcccatttttgctctagcgcctccagcggaaagaagtctacagaaattcacttccactccggcagcctcgttgggaaaaccgctatccatgtgaagggagccctggtcgacggcacggagttcacatttgaagggtcttgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcctgggtgattgctcccgtcaagctgatgttcgccatcatcaaaaagctcatgagaaccgtgagctgtctggttggcaaacttatggaccgggggagacaggtgattcacgaagagatcggagagaacggcgaagggaatcaagatgacgtccgcattgagatggcccggcctagacgcgtgcggcattggatgtattctcccgtgatcctgaccattctcgctatcggactggcggaaggctgcgatgagatggttcacgccgacagcaagctggtctcctgtagacaggggagcggcaacatgaaagagtgcattacaacgggacgcgctctgctccctgccgtgaatcccggccaggaagcctgtctgcattttaccgctccggggtctcctgattccaagtgcctgaagatcaaagtgaagcggatcaacctcaaatgtaagaaaagctcctcttacttcgtccccgacgccagaagccgctgcacatccgtgcggagatgtcgctgggcgggagattgccagtctggctgccctccccactttaccagcaattccttctctgacgactgggctgggaagatggatcgggccggactgggctttagcgggtgttccgacggctgcggaggcgccgcttgtgggtgcttcaacgccgctcctagctgtatcttttggagaaagtgggttgagaatccccacggaattatttggaaagtgtctccgtgcgccgcgtgggtcccttccgccgtgatcgaacttacaatgcccagcggcgaggttcggaccttccatcccatgtctgggattcctacgcaagtgttcaagggagtctccgtgacatatctgggcagcgatatggaagtttctggcctcaccgacctgtgtgagatcgaggaactgaaatccaagaaacttgctctcgccccgtgcaaccaggctgggatgggagtggtcggcaaggtgggggagatccagtgtagctccgaagagagcgcccgcaccattaaaaaggatggatgcatctggaacgcggacctggtgggcattgaactgagagtcgatgacgccgtttgttactctaagatcacaagcgtggaggctgtggccaattattccgctattcccaccacaatcgggggactccggtttgagagatctcacgatagccagggcaaaatctccggctctcctctggacattacggccatccgcgggagcttctccgtcaactaccggggacttagactgtctctcagcgaaattaccgccacatgcaccggcgaggtgacaaatgtttccgggtgctacagctgtatgaccggagctaaggtgtctatcaaactgcattccagcaagaactctacggcgcacgtccgctgcaaaggcgatgaaaccgccttttccgtgctggagggggttcacagctatattgtgagactttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaaactgggcacaaagcaagtttttcgctccagaaccaaacttgcctga

SEQ ID NO: 17445 - RNA, 738 nt, synthetic construct; identical to SEQ ID NO: 8315
  misc_feature 1..738: note = derived and/or modified CDS sequence (opt11) from SFTSV(HB29)__NC_018137.1__N
  source 1..738: mol_type = other RNA

SEQ ID NO: 17446 - RNA, 3222 nt, synthetic construct; identical to SEQ ID NO: 16367
  misc_feature 1..3222: note = derived and/or modified CDS sequence (opt11) from SFTSV(HB29)__NC_018138.1__GP
  source 1..3222: mol_type = other RNA

SEQ ID NO: 17447 - RNA, 3219 nt, synthetic construct
  misc_feature 1..3219: note = derived and/or modified CDS sequence (opt11) from SFTSV(HB29)__NC_018138.1__IgE-leader_Gn-Gc
  source 1..3219: mol_type = other RNA
atggattggacgtggatactctttctcgtggccgcggccacgcgcgtgcactcggactccgggcccatcatatgcgcaggccccatccacagcaacaaatcagcagggataccccacctcctcggatactcagagaaaatatgccaaatagacagattaatccacgtgagctcctggctgcggaaccactctcaattccaagggtacgtcggtcaacgagggggaagaagccaagtctcatactacccagcagaaaacagctactccagatggagcggattactatcgccttgcgacgcagactggctaggcatgctagtagtaaagaaagccaaagaatccgacatgatcgtgccaggcccctcttacaaaggaaaagtatttttcgaaaggccaacattcgacggatacgtcggctggggctgcggctccggaaaaagcaggactgagagcggggagctatgttcatcagacagcggcacgtcgagcggcctcctcccatcagaccgggtcctgtggatcggagacgtcgcctgccaacccatgaccccgataccagaagagacattcctagagctaaagagcttctcccaaagcgagttccccgacatatgcaaaatagacggcatagtcttcaatcaatgcgagggagaatccctccctcagcctttcgatgtcgcatggatggacgtggggcactcacataaaattatcatgcgagaacacaaaacgaaatgggtccaggaatccagcagcaaagatttcgtatgctataaagaaggaacaggaccctgctcagaatcagaggaaaaagcctgcaaaacctcaggctcgtgcagaggtgacatgcagttctgtaaagtcgccggatgcgaacacggggaagaagcaagcgaggccaaatgccgctgcagccttgtccacaagccaggagaagtagtcgtctcctacggcggcaccagggtccgccccaaatgctacggcttctccagaatgatggccaccctcgaagtcaacccgcccgaacaacgcatcggacaatgcacaggctgccacctcgaatgcataaacggcggagtgagactgatcaccctaacctccgagctccggagcgccaccgtgtgtgcatcccacttctgcagctccgcctcaagcggcaaaaagagtaccgaaatccacttccactcgggaagcctggtaggaaaaacagccatccatgtgaaaggagccctcgtagacggaacagagttcacattcgaaggaagctgcatgttccctgacggctgcgacgccgtagactgcaccttttgccgagagttcctcaaaaacccccaatgctatcccgccaagaaatggctttttatcataattgtaatcttgctcggctacgccggcctaatgctactcaccaacgtgctcaaagccataggagtatgggggtcatgggtcatcgccccagtgaaactaatgttcgcaataatcaaaaagctaatgcgaacggtatcatgcctagtcggaaaactaatggacagaggacgccaagtaatacacgaagaaatcggggagaacggggagggtaaccaggacgacgtccgaatagagatggcgaggccccggagagtgcgccactggatgtacagcccagtaatactaaccattctagccataggactggctgaaggatgtgatgaaatggtacatgccgatagcaaactggtatcctgccggcaaggatccggaaacatgaaggaatgcatcacaacagggagagccctgctaccggcagtaaaccctggacaagaagcatgcctgcactttaccgcgccggggagccccgacagcaaatgcctcaagataaaggtcaagcgaataaacctaaaatgcaagaaatctagcagttacttcgtaccagacgcaagaagcagatgcacctcagttcgacggtgccgctgggccggtgactgccagtccggctgtccgccccatttcacgagcaacagcttcagtgacgactgggcaggcaaaatggacagagctggactcggcttcagcggctgcagcgacggctgtgggggagcggcctgcgggtgctttaacgcagcacctagctgcatcttctggcgaaagtgggtcgaaaacccacacgggataatatggaaggtcagcccctgcgcagcatgggtaccatccgccgtcatagaattaacaatgccgtccggcgaagttcgcacattccatcccatgtcaggcataccaacccaggtctttaaaggcgtctcagtaacctacctaggatcagacatggaggtaagcggacttacagacctctgtgaaatagaggaactcaagagcaagaaactcgcactcgcgccttgcaaccaggcaggcatgggcgtagtcggcaaagttggggaaatccagtgctcaagcgaagaaagcgcccgcaccatcaagaaagacggatgcatctggaacgcggatctagtcggaatcgagctacgcgttgatgacgccgtatgctacagcaaaatcacctcagtagaggccgtcgcaaactactccgccatacccacaactataggcggtctcaggttcgagcgctcccacgactcccagggaaaaatatcaggctcgcccctagacataaccgccatccgaggctcattctcagtcaactaccgcggccttcgcctcagcctctccgaaattacggcaacctgcaccggagaagtaacgaacgtctcaggttgctattcgtgcatgaccggagccaaagtcagcataaaactgcactccagcaaaaactcaacagcgcacgtacgatgcaaaggcgacgaaacagcattctcagtacttgaaggagtccactcctacatcgttaggctatcctttgaccatgccgtcgtcgacgaacaatgtcaactaaactgcgggggacacgaatcgcaagtgactctaaaaggaaacctgatatttctcgacgtcccgaaattcgtagacgggtcttatatgcagacataccacagcacggtaccaactggagccaacataccatcacccacagactggctgaacgctctattcggaaacggcctctcaaggtggatactaggggtcataggcgttctcctaggaggcctcgcactattcttcctaatcatgtttctgctcaaactcggcacaaagcaagtattcagaagccgaactaaactagcgtga

SEQ ID NO: 17448 - RNA, 955 nt, synthetic construct
  misc_feature 1..955: note = mRNA product Design1 comprising derived and/or modified sequence from SFTSV(HB29)__NC_018137.1__N (wt)
  source 1..955: mol_type = other RNA
gggagaaagcttaccatgtcggagtggtccaggattgcagtggagtttggtgagcagcagctcaatttgactgagcttgaggacttcgcgagagagctggcctatgaaggccttgaccctgctttgatcatcaagaagctgaaggagacaggtggagatgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactccagtgagggttgcgcagagccttcccacttggacatgtgctgctgcagcagctctaaaggagtatctcccagtagggccagccgtcatgaacctgaaggttgagaattatccccctgagatgatgtgcatggcctttggatccctgattccaactgcgggggtatctgaagccacaaccaagaccctgatggaggcctactctctgtggcaagatgccttcaccaagactatcaatgtaaagatgcgcggagccagcaagacagaagtttacaactccttcagggaccctcttcatgctgctgtgaactctgtcttctttcccaatgatgttcgggtaaagtggctgaaggccaaggggatccttggcccagatggggtccccagcagagctgctgaggttgctgctgctgcttacagaaacctgtaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17449 - RNA, 3439 nt, synthetic construct
  misc_feature 1..3439: note = mRNA product Design1 comprising derived and/or modified sequence from SFTSV(HB29)__NC_018138.1__GP (wt)
  source 1..3439: mol_type = other RNA
gggagaaagcttaccatgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17450 - RNA, 3439 nt, synthetic construct
  misc_feature 1..3439: note = mRNA product Design1 comprising derived and/or modified sequence from SFTSV(HB29)__NC_018138.1__GP (wt)
  source 1..3439: mol_type = other RNA
gggagaaagcttaccatgatgaaagtcatctggttctcctctctgatctgcttagtcattcaatgcagtggggattcgggcccaatcatctgcgcaggacccatccactcaaacaagagtgctggcataccccacctccttggttactctgagaagatttgtcagatagatcggctgatacatgtttcgtcatggctcaggaaccactcgcaatttcaaggctacgttgggcagcgaggtggacgctctcaggttagctactacccagctgagaactcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgagttcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgagttcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagaactcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattacaagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17451 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (wt)
  source 1..3436: mol_type = other RNA
gggagaaagcttaccatggactggacctggatcctgttcctcgtggccgccgcgacccgcgtccacagcgattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17452 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (wt)
  source 1..3436: mol_type = other RNA
gggagaaagcttaccatggactggacctggatcctgttcctcgtggccgccgcgacccgcgtccacagcgattcgggcccaatcatctgcgcaggacccatccactcaaacaagagtgctggcataccccacctccttggttactctgagaagatttgtcagatagatcggctgatacatgtttcgtcatggctcaggaaccactcgcaatttcaaggctacgttgggcagcgaggtggacgctctcaggttagctactacccagctgagaactcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgagttcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgagttcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagaactcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattacaagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17453 - RNA, 955 nt, synthetic construct
  misc_feature 1..955: note = mRNA product Design1 comprising derived and/or modified sequence from SFTSV(HB29)__NC_018137.1__N (opt4)
  source 1..955: mol_type = other RNA
gggagaaagcttaccatgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17454 - RNA, 3439 nt, synthetic construct
  misc_feature 1..3439: note = mRNA product Design1 comprising derived and/or modified sequence from SFTSV(HB29)__NC_018138.1__GP (opt4)
  source 1..3439: mol_type = other RNA
gggagaaagcttaccatgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcaccagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagactgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17455 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (opt4)
  source 1..3436: mol_type = other RNA
gggagaaagcttaccatggactggacctggatcctgttcctggtggccgccgccaccagagtgcacagcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcaccagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagactgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17456 - RNA, 955 nt, synthetic construct
  misc_feature 1..955: note = mRNA product Design1 comprising derived and/or modified sequence from SFTSV(HB29)__NC_018137.1__N (opt3)
  source 1..955: mol_type = other RNA
gggagaaagcttaccatgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagtgcctagcagagcagctgaagtcgccgctgccgcatacaggaatctatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17457 - RNA, 3439 nt, synthetic construct
  misc_feature 1..3439: note = mRNA product Design1 comprising derived and/or modified sequence from SFTSV(HB29)__NC_018138.1__GP (opt3)
  source 1..3439: mol_type = other RNA
gggagaaagcttaccatgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggacaagggtgcggcccaaatgttacggcttcagtcgcatgatggccaccctggaggtcaaccctccagaacagcgaatcggacaatgcactggctgtcaccttgagtgcatcaatgggggagtgagattgattacactgaccagcgagctaaggtccgctacggtttgtgcctctcatttttgctcgagcgcgtcctcaggtaagaagagtactgaaatacacttccactctggcagcctcgtggggaaaaccgcaatccatgtcaagggagccctggtggacggcacagagttcacttttgaaggttcctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcatgggtgatcgcccccgtcaaacttatgttcgcgattatcaagaagctgatgcgtaccgtgagctgtttggttggaaaactaatggaccgcggtagacaggtgattcacgaagagataggcgagaacggggaaggaaatcaagatgacgtaaggatcgagatggcccggccacgacgcgtcagacattggatgtattctcctgtgattctgacgatcctcgcaatcggcctggctgaaggttgcgatgagatggttcacgccgactccaaacttgtgagttgtaggcaggggagcggcaacatgaaggagtgcattactacaggacgggctctgttgcccgccgtcaatccaggccaggaagcatgtctccattttaccgcccccgggtctcctgattccaagtgcctgaagataaaagtgaagcgcatcaacttaaaatgtaagaaatcaagtagctacttcgtaccagacgctagatcgaggtgcacttccgtgcgtcggtgtcgatgggcgggagattgccagtctggctgcccgccccactttacaagcaattcattcagtgacgactgggcaggtaagatggatagagccgggctgggattttccggctgttctgacggttgcggcggggctgcctgtggatgcttcaacgcagcccctagctgtatcttttggaggaagtgggttgagaatccacacggcattatttggaaagtctccccctgcgctgcctgggtgccttcagcagtgatcgaactaaccatgccaagcggggaggtccgcacgttccatcccatgagtggaataccgacccaagttttcaagggcgtgtctgtgacatatctcggttccgatatggaagtaagcgggctgactgacctttgtgagatcgaggaattgaaatcgaagaaactggcgctcgctccttgcaaccaggccggaatgggcgtcgtgggtaaggttggcgagattcagtgttcatctgaagagagtgcacggaccatcaaaaaggatgggtgcatttggaacgccgacctggtgggaatcgaacttagagtcgatgacgctgtgtgttactccaagataacaagcgttgaggccgtggcaaattattctgctattccaactaccatcggcgggctgaggtttgagcgcagccacgattcccagggaaaaatttcaggcagtcccttggacatcacagccatacgaggtagcttctctgtaaactaccgggggctccgtctgtccttatcagaaatcaccgcgacttgcacgggagaggtcacaaatgtgagtggctgctacagctgtatgaccggtgccaaggtgtccattaaactgcattcttcgaagaacagcactgctcacgtcagatgcaaaggcgatgaaaccgcattttcagttctagagggggtgcactcctatatcgtaaggctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaaactgggaaccaagcaagtgtttcggagcagaactaaacttgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17458 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (opt3)
  source 1..3436: mol_type = other RNA
gggagaaagcttaccatggactggacctggatcctgttcctcgtggccgctgcaacaagagtccacagcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggacaagggtgcggcccaaatgttacggcttcagtcgcatgatggccaccctggaggtcaaccctccagaacagcgaatcggacaatgcactggctgtcaccttgagtgcatcaatgggggagtgagattgattacactgaccagcgagctaaggtccgctacggtttgtgcctctcatttttgctcgagcgcgtcctcaggtaagaagagtactgaaatacacttccactctggcagcctcgtggggaaaaccgcaatccatgtcaagggagccctggtggacggcacagagttcacttttgaaggttcctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcatgggtgatcgcccccgtcaaacttatgttcgcgattatcaagaagctgatgcgtaccgtgagctgtttggttggaaaactaatggaccgcggtagacaggtgattcacgaagagataggcgagaacggggaaggaaatcaagatgacgtaaggatcgagatggcccggccacgacgcgtcagacattggatgtattctcctgtgattctgacgatcctcgcaatcggcctggctgaaggttgcgatgagatggttcacgccgactccaaacttgtgagttgtaggcaggggagcggcaacatgaaggagtgcattactacaggacgggctctgttgcccgccgtcaatccaggccaggaagcatgtctccattttaccgcccccgggtctcctgattccaagtgcctgaagataaaagtgaagcgcatcaacttaaaatgtaagaaatcaagtagctacttcgtaccagacgctagatcgaggtgcacttccgtgcgtcggtgtcgatgggcgggagattgccagtctggctgcccgccccactttacaagcaattcattcagtgacgactgggcaggtaagatggatagagccgggctgggattttccggctgttctgacggttgcggcggggctgcctgtggatgcttcaacgcagcccctagctgtatcttttggaggaagtgggttgagaatccacacggcattatttggaaagtctccccctgcgctgcctgggtgccttcagcagtgatcgaactaaccatgccaagcggggaggtccgcacgttccatcccatgagtggaataccgacccaagttttcaagggcgtgtctgtgacatatctcggttccgatatggaagtaagcgggctgactgacctttgtgagatcgaggaattgaaatcgaagaaactggcgctcgctccttgcaaccaggccggaatgggcgtcgtgggtaaggttggcgagattcagtgttcatctgaagagagtgcacggaccatcaaaaaggatgggtgcatttggaacgccgacctggtgggaatcgaacttagagtcgatgacgctgtgtgttactccaagataacaagcgttgaggccgtggcaaattattctgctattccaactaccatcggcgggctgaggtttgagcgcagccacgattcccagggaaaaatttcaggcagtcccttggacatcacagccatacgaggtagcttctctgtaaactaccgggggctccgtctgtccttatcagaaatcaccgcgacttgcacgggagaggtcacaaatgtgagtggctgctacagctgtatgaccggtgccaaggtgtccattaaactgcattcttcgaagaacagcactgctcacgtcagatgcaaaggcgatgaaaccgcattttcagttctagagggggtgcactcctatatcgtaaggctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaaactgggaaccaagcaagtgtttcggagcagaactaaacttgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17459 - RNA, 955 nt, synthetic construct
  misc_feature 1..955: note = mRNA product Design1 comprising derived and/or modified sequence from SFTSV(HB29)__NC_018137.1__N (opt1)
  source 1..955: mol_type = other RNA
gggagaaagcttaccatgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgtgcccagccgcgccgccgaggtggcggccgccgcctaccggaacctctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17460 - RNA, 3439 nt, synthetic construct
  misc_feature 1..3439: note = mRNA product Design1 comprising derived and/or modified sequence from SFTSV(HB29)__NC_018138.1__GP (opt1)
  source 1..3439: mol_type = other RNA
gggagaaagcttaccatgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcacccgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccagctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcatcacgaccggccgcgccctgctgcccgccgtgaaccccgggcaggaggcctgcctccacttcaccgcccccggcagcccggacagcaagtgcctgaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccacgaccatcggcggcctccgcttcgagcggagccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacatcgtgcggctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17461 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (opt1)
  source 1..3436: mol_type = other RNA
gggagaaagcttaccatggactggacctggatcctgttcctcgtggccgccgcgacccgcgtccacagcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcacccgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccagctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcatcacgaccggccgcgccctgctgcccgccgtgaaccccgggcaggaggcctgcctccacttcaccgcccccggcagcccggacagcaagtgcctgaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccacgaccatcggcggcctccgcttcgagcggagccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacatcgtgcggctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17462 - RNA, 955 nt, synthetic construct
  misc_feature 1..955: note = mRNA product Design1 comprising derived and/or modified sequence from SFTSV(HB29)__NC_018137.1__N (opt5)
  source 1..955: mol_type = other RNA
gggagaaagcttaccatgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggttcctagccgggctgcggaagtggccgctgccgcctaccgcaatctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17463 - RNA, 3439 nt, synthetic construct
  misc_feature 1..3439: note = mRNA product Design1 comprising derived and/or modified sequence from SFTSV(HB29)__NC_018138.1__GP (opt5)
  source 1..3439: mol_type = other RNA
gggagaaagcttaccatgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaggcttctgaagccaaatgtcggtgctccctggtgcataagcctggggaagtggtcgtgagctacggaggcacacgcgttagacccaaatgttacgggttctcccggatgatggcgacccttgaggtgaaccctcccgaacagcgcatcggacaatgcacgggctgtcacctggagtgcattaatgggggcgtcagactcatcaccctgacatctgagctgcggagcgccaccgtgtgtgcttcccatttttgctctagcgcctccagcggaaagaagtctacagaaattcacttccactccggcagcctcgttgggaaaaccgctatccatgtgaagggagccctggtcgacggcacggagttcacatttgaagggtcttgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcctgggtgattgctcccgtcaagctgatgttcgccatcatcaaaaagctcatgagaaccgtgagctgtctggttggcaaacttatggaccgggggagacaggtgattcacgaagagatcggagagaacggcgaagggaatcaagatgacgtccgcattgagatggcccggcctagacgcgtgcggcattggatgtattctcccgtgatcctgaccattctcgctatcggactggcggaaggctgcgatgagatggttcacgccgacagcaagctggtctcctgtagacaggggagcggcaacatgaaagagtgcattacaacgggacgcgctctgctccctgccgtgaatcccggccaggaagcctgtctgcattttaccgctccggggtctcctgattccaagtgcctgaagatcaaagtgaagcggatcaacctcaaatgtaagaaaagctcctcttacttcgtccccgacgccagaagccgctgcacatccgtgcggagatgtcgctgggcgggagattgccagtctggctgccctccccactttaccagcaattccttctctgacgactgggctgggaagatggatcgggccggactgggctttagcgggtgttccgacggctgcggaggcgccgcttgtgggtgcttcaacgccgctcctagctgtatcttttggagaaagtgggttgagaatccccacggaattatttggaaagtgtctccgtgcgccgcgtgggtcccttccgccgtgatcgaacttacaatgcccagcggcgaggttcggaccttccatcccatgtctgggattcctacgcaagtgttcaagggagtctccgtgacatatctgggcagcgatatggaagtttctggcctcaccgacctgtgtgagatcgaggaactgaaatccaagaaacttgctctcgccccgtgcaaccaggctgggatgggagtggtcggcaaggtgggggagatccagtgtagctccgaagagagcgcccgcaccattaaaaaggatggatgcatctggaacgcggacctggtgggcattgaactgagagtcgatgacgccgtttgttactctaagatcacaagcgtggaggctgtggccaattattccgctattcccaccacaatcgggggactccggtttgagagatctcacgatagccagggcaaaatctccggctctcctctggacattacggccatccgcgggagcttctccgtcaactaccggggacttagactgtctctcagcgaaattaccgccacatgcaccggcgaggtgacaaatgtttccgggtgctacagctgtatgaccggagctaaggtgtctatcaaactgcattccagcaagaactctacggcgcacgtccgctgcaaaggcgatgaaaccgccttttccgtgctggagggggttcacagctatattgtgagactttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaaactgggcacaaagcaagtttttcgctccagaaccaaacttgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17464 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (opt5)
  source 1..3436: mol_type = other RNA
gggagaaagcttaccatggactggacctggatcctgttcctcgtggccgctgccacaagagtccacagcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaggcttctgaagccaaatgtcggtgctccctggtgcataagcctggggaagtggtcgtgagctacggaggcacacgcgttagacccaaatgttacgggttctcccggatgatggcgacccttgaggtgaaccctcccgaacagcgcatcggacaatgcacgggctgtcacctggagtgcattaatgggggcgtcagactcatcaccctgacatctgagctgcggagcgccaccgtgtgtgcttcccatttttgctctagcgcctccagcggaaagaagtctacagaaattcacttccactccggcagcctcgttgggaaaaccgctatccatgtgaagggagccctggtcgacggcacggagttcacatttgaagggtcttgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcctgggtgattgctcccgtcaagctgatgttcgccatcatcaaaaagctcatgagaaccgtgagctgtctggttggcaaacttatggaccgggggagacaggtgattcacgaagagatcggagagaacggcgaagggaatcaagatgacgtccgcattgagatggcccggcctagacgcgtgcggcattggatgtattctcccgtgatcctgaccattctcgctatcggactggcggaaggctgcgatgagatggttcacgccgacagcaagctggtctcctgtagacaggggagcggcaacatgaaagagtgcattacaacgggacgcgctctgctccctgccgtgaatcccggccaggaagcctgtctgcattttaccgctccggggtctcctgattccaagtgcctgaagatcaaagtgaagcggatcaacctcaaatgtaagaaaagctcctcttacttcgtccccgacgccagaagccgctgcacatccgtgcggagatgtcgctgggcgggagattgccagtctggctgccctccccactttaccagcaattccttctctgacgactgggctgggaagatggatcgggccggactgggctttagcgggtgttccgacggctgcggaggcgccgcttgtgggtgcttcaacgccgctcctagctgtatcttttggagaaagtgggttgagaatccccacggaattatttggaaagtgtctccgtgcgccgcgtgggtcccttccgccgtgatcgaacttacaatgcccagcggcgaggttcggaccttccatcccatgtctgggattcctacgcaagtgttcaagggagtctccgtgacatatctgggcagcgatatggaagtttctggcctcaccgacctgtgtgagatcgaggaactgaaatccaagaaacttgctctcgccccgtgcaaccaggctgggatgggagtggtcggcaaggtgggggagatccagtgtagctccgaagagagcgcccgcaccattaaaaaggatggatgcatctggaacgcggacctggtgggcattgaactgagagtcgatgacgccgtttgttactctaagatcacaagcgtggaggctgtggccaattattccgctattcccaccacaatcgggggactccggtttgagagatctcacgatagccagggcaaaatctccggctctcctctggacattacggccatccgcgggagcttctccgtcaactaccggggacttagactgtctctcagcgaaattaccgccacatgcaccggcgaggtgacaaatgtttccgggtgctacagctgtatgaccggagctaaggtgtctatcaaactgcattccagcaagaactctacggcgcacgtccgctgcaaaggcgatgaaaccgccttttccgtgctggagggggttcacagctatattgtgagactttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaaactgggcacaaagcaagtttttcgctccagaaccaaacttgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17465 - RNA, 955 nt, synthetic construct
  misc_feature 1..955: note = mRNA product Design1 comprising derived and/or modified sequence from SFTSV(HB29)__NC_018137.1__N (opt11)
  source 1..955: mol_type = other RNA
gggagaaagcttaccatgagcgagtggtcgcgcatagccgtggagttcggcgaacaacaactcaacctaacagaattggaagacttcgcacgcgagctagcgtacgagggcctggacccggccctaatcatcaaaaagctaaaggaaacgggaggggacgactgggtaaaagacaccaaattcataatagtgttcgcgctaacgcgcgggaacaagatcgtgaaagcgagcggaaaaatgagcaacagcgggagcaagcgcctgatggcgcttcaggaaaagtacgggctcgtggaacgggccgagaccaggctctcgataacgcccgtgcgcgtggcacagagcctgcccacgtggacatgcgcagccgcagccgcactaaaagaatacctcccggtagggccagcggtcatgaacttgaaagtagaaaactacccgcccgagatgatgtgcatggccttcggctcgctaataccaacggccggggtctcggaagcgaccacgaaaacactcatggaagcgtactcactctggcaagacgccttcaccaaaaccataaacgtaaaaatgcgaggggcctcgaaaacggaagtgtacaacagctttcgcgaccccctgcacgcggccgtgaactcggtcttcttcccgaacgatgtaagggtcaagtggctgaaagcaaaagggatcctgggcccggacggggtcccgagcagggccgcggaagtggccgcagccgcgtacaggaacctgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17466 - RNA, 3439 nt, synthetic construct
  misc_feature 1..3439: note = mRNA product Design1 comprising derived and/or modified sequence from SFTSV(HB29)__NC_018138.1__GP (opt11)
  source 1..3439: mol_type = other RNA
gggagaaagcttaccatgatgaaagtaatatggttctcttccctcatatgcctagtcatccagtgcagcggcgactccgggcccatcatatgcgcaggccccatccacagcaacaaatcagcagggataccccacctcctcggatactcagagaaaatatgccaaatagacagattaatccacgtgagctcctggctgcggaaccactctcaattccaagggtacgtcggtcaacgagggggaagaagccaagtctcatactacccagcagaaaacagctactccagatggagcggattactatcgccttgcgacgcagactggctaggcatgctagtagtaaagaaagccaaagaatccgacatgatcgtgccaggcccctcttacaaaggaaaagtatttttcgaaaggccaacattcgacggatacgtcggctggggctgcggctccggaaaaagcaggactgagagcggggagctatgttcatcagacagcggcacgtcgagcggcctcctcccatcagaccgggtcctgtggatcggagacgtcgcctgccaacccatgaccccgataccagaagagacattcctagagctaaagagcttctcccaaagcgagttccccgacatatgcaaaatagacggcatagtcttcaatcaatgcgagggagaatccctccctcagcctttcgatgtcgcatggatggacgtggggcactcacataaaattatcatgcgagaacacaaaacgaaatgggtccaggaatccagcagcaaagatttcgtatgctataaagaaggaacaggaccctgctcagaatcagaggaaaaagcctgcaaaacctcaggctcgtgcagaggtgacatgcagttctgtaaagtcgccggatgcgaacacggggaagaagcaagcgaggccaaatgccgctgcagccttgtccacaagccaggagaagtagtcgtctcctacggcggcaccagggtccgccccaaatgctacggcttctccagaatgatggccaccctcgaagtcaacccgcccgaacaacgcatcggacaatgcacaggctgccacctcgaatgcataaacggcggagtgagactgatcaccctaacctccgagctccggagcgccaccgtgtgtgcatcccacttctgcagctccgcctcaagcggcaaaaagagtaccgaaatccacttccactcgggaagcctggtaggaaaaacagccatccatgtgaaaggagccctcgtagacggaacagagttcacattcgaaggaagctgcatgttccctgacggctgcgacgccgtagactgcaccttttgccgagagttcctcaaaaacccccaatgctatcccgccaagaaatggctttttatcataattgtaatcttgctcggctacgccggcctaatgctactcaccaacgtgctcaaagccataggagtatgggggtcatgggtcatcgccccagtgaaactaatgttcgcaataatcaaaaagctaatgcgaacggtatcatgcctagtcggaaaactaatggacagaggacgccaagtaatacacgaagaaatcggggagaacggggagggtaaccaggacgacgtccgaatagagatggcgaggccccggagagtgcgccactggatgtacagcccagtaatactaaccattctagccataggactggctgaaggatgtgatgaaatggtacatgccgatagcaaactggtatcctgccggcaaggatccggaaacatgaaggaatgcatcacaacagggagagccctgctaccggcagtaaaccctggacaagaagcatgcctgcactttaccgcgccggggagccccgacagcaaatgcctcaagataaaggtcaagcgaataaacctaaaatgcaagaaatctagcagttacttcgtaccagacgcaagaagcagatgcacctcagttcgacggtgccgctgggccggtgactgccagtccggctgtccgccccatttcacgagcaacagcttcagtgacgactgggcaggcaaaatggacagagctggactcggcttcagcggctgcagcgacggctgtgggggagcggcctgcgggtgctttaacgcagcacctagctgcatcttctggcgaaagtgggtcgaaaacccacacgggataatatggaaggtcagcccctgcgcagcatgggtaccatccgccgtcatagaattaacaatgccgtccggcgaagttcgcacattccatcccatgtcaggcataccaacccaggtctttaaaggcgtctcagtaacctacctaggatcagacatggaggtaagcggacttacagacctctgtgaaatagaggaactcaagagcaagaaactcgcactcgcgccttgcaaccaggcaggcatgggcgtagtcggcaaagttggggaaatccagtgctcaagcgaagaaagcgcccgcaccatcaagaaagacggatgcatctggaacgcggatctagtcggaatcgagctacgcgttgatgacgccgtatgctacagcaaaatcacctcagtagaggccgtcgcaaactactccgccatacccacaactataggcggtctcaggttcgagcgctcccacgactcccagggaaaaatatcaggctcgcccctagacataaccgccatccgaggctcattctcagtcaactaccgcggccttcgcctcagcctctccgaaattacggcaacctgcaccggagaagtaacgaacgtctcaggttgctattcgtgcatgaccggagccaaagtcagcataaaactgcactccagcaaaaactcaacagcgcacgtacgatgcaaaggcgacgaaacagcattctcagtacttgaaggagtccactcctacatcgttaggctatcctttgaccatgccgtcgtcgacgaacaatgtcaactaaactgcgggggacacgaatcgcaagtgactctaaaaggaaacctgatatttctcgacgtcccgaaattcgtagacgggtcttatatgcagacataccacagcacggtaccaactggagccaacataccatcacccacagactggctgaacgctctattcggaaacggcctctcaaggtggatactaggggtcataggcgttctcctaggaggcctcgcactattcttcctaatcatgtttctgctcaaactcggcacaaagcaagtattcagaagccgaactaaactagcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17467 - RNA, 3436 nt, synthetic construct
  misc_feature 1..3436: note = mRNA product Design1 comprising derived and/or modified sequence from SFTSV(HB29)__NC_018138.1__IgE-leader_Gn-Gc (opt11)
  source 1..3436: mol_type = other RNA
gggagaaagcttaccatggattggacgtggatactctttctcgtggccgcggccacgcgcgtgcactcggactccgggcccatcatatgcgcaggccccatccacagcaacaaatcagcagggataccccacctcctcggatactcagagaaaatatgccaaatagacagattaatccacgtgagctcctggctgcggaaccactctcaattccaagggtacgtcggtcaacgagggggaagaagccaagtctcatactacccagcagaaaacagctactccagatggagcggattactatcgccttgcgacgcagactggctaggcatgctagtagtaaagaaagccaaagaatccgacatgatcgtgccaggcccctcttacaaaggaaaagtatttttcgaaaggccaacattcgacggatacgtcggctggggctgcggctccggaaaaagcaggactgagagcggggagctatgttcatcagacagcggcacgtcgagcggcctcctcccatcagaccgggtcctgtggatcggagacgtcgcctgccaacccatgaccccgataccagaagagacattcctagagctaaagagcttctcccaaagcgagttccccgacatatgcaaaatagacggcatagtcttcaatcaatgcgagggagaatccctccctcagcctttcgatgtcgcatggatggacgtggggcactcacataaaattatcatgcgagaacacaaaacgaaatgggtccaggaatccagcagcaaagatttcgtatgctataaagaaggaacaggaccctgctcagaatcagaggaaaaagcctgcaaaacctcaggctcgtgcagaggtgacatgcagttctgtaaagtcgccggatgcgaacacggggaagaagcaagcgaggccaaatgccgctgcagccttgtccacaagccaggagaagtagtcgtctcctacggcggcaccagggtccgccccaaatgctacggcttctccagaatgatggccaccctcgaagtcaacccgcccgaacaacgcatcggacaatgcacaggctgccacctcgaatgcataaacggcggagtgagactgatcaccctaacctccgagctccggagcgccaccgtgtgtgcatcccacttctgcagctccgcctcaagcggcaaaaagagtaccgaaatccacttccactcgggaagcctggtaggaaaaacagccatccatgtgaaaggagccctcgtagacggaacagagttcacattcgaaggaagctgcatgttccctgacggctgcgacgccgtagactgcaccttttgccgagagttcctcaaaaacccccaatgctatcccgccaagaaatggctttttatcataattgtaatcttgctcggctacgccggcctaatgctactcaccaacgtgctcaaagccataggagtatgggggtcatgggtcatcgccccagtgaaactaatgttcgcaataatcaaaaagctaatgcgaacggtatcatgcctagtcggaaaactaatggacagaggacgccaagtaatacacgaagaaatcggggagaacggggagggtaaccaggacgacgtccgaatagagatggcgaggccccggagagtgcgccactggatgtacagcccagtaatactaaccattctagccataggactggctgaaggatgtgatgaaatggtacatgccgatagcaaactggtatcctgccggcaaggatccggaaacatgaaggaatgcatcacaacagggagagccctgctaccggcagtaaaccctggacaagaagcatgcctgcactttaccgcgccggggagccccgacagcaaatgcctcaagataaaggtcaagcgaataaacctaaaatgcaagaaatctagcagttacttcgtaccagacgcaagaagcagatgcacctcagttcgacggtgccgctgggccggtgactgccagtccggctgtccgccccatttcacgagcaacagcttcagtgacgactgggcaggcaaaatggacagagctggactcggcttcagcggctgcagcgacggctgtgggggagcggcctgcgggtgctttaacgcagcacctagctgcatcttctggcgaaagtgggtcgaaaacccacacgggataatatggaaggtcagcccctgcgcagcatgggtaccatccgccgtcatagaattaacaatgccgtccggcgaagttcgcacattccatcccatgtcaggcataccaacccaggtctttaaaggcgtctcagtaacctacctaggatcagacatggaggtaagcggacttacagacctctgtgaaatagaggaactcaagagcaagaaactcgcactcgcgccttgcaaccaggcaggcatgggcgtagtcggcaaagttggggaaatccagtgctcaagcgaagaaagcgcccgcaccatcaagaaagacggatgcatctggaacgcggatctagtcggaatcgagctacgcgttgatgacgccgtatgctacagcaaaatcacctcagtagaggccgtcgcaaactactccgccatacccacaactataggcggtctcaggttcgagcgctcccacgactcccagggaaaaatatcaggctcgcccctagacataaccgccatccgaggctcattctcagtcaactaccgcggccttcgcctcagcctctccgaaattacggcaacctgcaccggagaagtaacgaacgtctcaggttgctattcgtgcatgaccggagccaaagtcagcataaaactgcactccagcaaaaactcaacagcgcacgtacgatgcaaaggcgacgaaacagcattctcagtacttgaaggagtccactcctacatcgttaggctatcctttgaccatgccgtcgtcgacgaacaatgtcaactaaactgcgggggacacgaatcgcaagtgactctaaaaggaaacctgatatttctcgacgtcccgaaattcgtagacgggtcttatatgcagacataccacagcacggtaccaactggagccaacataccatcacccacagactggctgaacgctctattcggaaacggcctctcaaggtggatactaggggtcataggcgttctcctaggaggcctcgcactattcttcctaatcatgtttctgctcaaactcggcacaaagcaagtattcagaagccgaactaaactagcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17468 - RNA, 1120 nt, synthetic construct
  misc_feature 1..1120: note = mRNA product Design2 comprising derived and/or modified sequence from SFTSV(HB29)__NC_018137.1__N (wt)
  source 1..1120: mol_type = other RNA
ggggcgctgcctacggaggtggcagccatctccttctcggcatcaagcttaccatgtcggagtggtccaggattgcagtggagtttggtgagcagcagctcaatttgactgagcttgaggacttcgcgagagagctggcctatgaaggccttgaccctgctttgatcatcaagaagctgaaggagacaggtggagatgattgggtgaaggatacaaagttcatcattgtctttgccctgactcgaggcaataagatcgtcaaggcatcagggaaaatgtcaaactcagggtccaagaggttgatggcactccaagagaaatatggactggttgagagggcagagaccaggctctcaatcactccagtgagggttgcgcagagccttcccacttggacatgtgctgctgcagcagctctaaaggagtatctcccagtagggccagccgtcatgaacctgaaggttgagaattatccccctgagatgatgtgcatggcctttggatccctgattccaactgcgggggtatctgaagccacaaccaagaccctgatggaggcctactctctgtggcaagatgccttcaccaagactatcaatgtaaagatgcgcggagccagcaagacagaagtttacaactccttcagggaccctcttcatgctgctgtgaactctgtcttctttcccaatgatgttcgggtaaagtggctgaaggccaaggggatccttggcccagatggggtccccagcagagctgctgaggttgctgctgctgcttacagaaacctgtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17469 - RNA, 3604 nt, synthetic construct
  misc_feature 1..3604: note = mRNA product Design2 comprising derived and/or modified sequence from SFTSV(HB29)__NC_018138.1__GP (wt)
  source 1..3604: mol_type = other RNA
ggggcgctgcctacggaggtggcagccatctccttctcggcatcaagcttaccatgatgaaagtcatctggttctcctctctgatctgcttagtcattcaatgcagtggggattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17470 - RNA, 3604 nt, synthetic construct
  misc_feature 1..3604: note = mRNA product Design2 comprising derived and/or modified sequence from SFTSV(HB29)__NC_018138.1__GP (wt)
  source 1..3604: mol_type = other RNA
ggggcgctgcctacggaggtggcagccatctccttctcggcatcaagcttaccatgatgaaagtcatctggttctcctctctgatctgcttagtcattcaatgcagtggggattcgggcccaatcatctgcgcaggacccatccactcaaacaagagtgctggcataccccacctccttggttactctgagaagatttgtcagatagatcggctgatacatgtttcgtcatggctcaggaaccactcgcaatttcaaggctacgttgggcagcgaggtggacgctctcaggttagctactacccagctgagaactcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgagttcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgagttcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagaactcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattacaagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17471 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (wt)
  source 1..3601: mol_type = other RNA
ggggcgctgcctacggaggtggcagccatctccttctcggcatcaagcttaccatggactggacctggatcctgttcctcgtggccgccgcgacccgcgtccacagcgattcgggcccaatcatctgcgcaggacccatccactcaaacaagagtgctggcataccccacctgcttggttactctgagaagatttgtcagatagatcggctgatacatgtttcgtcatggctcaggaaccactcgcaatttcaaggctacgttgggcagcgaggtggacgctctcaggttagctactacccagctgagaattcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgaattcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgaattcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagagctcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattactagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17472 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (wt)
  source 1..3601: mol_type = other RNA
ggggcgctgcctacggaggtggcagccatctccttctcggcatcaagcttaccatggactggacctggatcctgttcctcgtggccgccgcgacccgcgtccacagcgattcgggcccaatcatctgcgcaggacccatccactcaaacaagagtgctggcataccccacctccttggttactctgagaagatttgtcagatagatcggctgatacatgtttcgtcatggctcaggaaccactcgcaatttcaaggctacgttgggcagcgaggtggacgctctcaggttagctactacccagctgagaactcttactcgaggtggagtggacttctaagcccctgtgatgctgattggcttgggatgcttgtcgtgaagaaggctaaggagtctgatatgatagttcctgggccttcatacaaggggaaagtcttttttgaacggccaacttttgatggatacgtaggctggggctgtggcagtgggaagtctaggactgagtcaggagagctctgcagttcagactcagggacaagttctggtcttctgccctcggatagggttctctggataggtgatgttgcttgtcagcctatgacacccatccctgaggagacatttctggagctgaagagttttagccaaagtgagttcccagacatatgtaaaattgatggcattgtgttcaaccagtgtgagggtgagagtctaccccagccctttgatgttgcatggatggatgttggccactctcataagatcatcatgagggagcacaagaccaaatgggtacaagagagctcatccaaggattttgtgtgctacaaggaagggactggaccttgttctgaatcagaagaaaaggcttgtaagaccagtggatcatgcagaggggacatgcagttttgcaaggtggcaggttgcgaacatggagaggaggcatctgaggccaagtgtagatgctcacttgtgcacaagcctggggaagtcgttgtgtcatatggagggacgcgtgtcagaccaaagtgctacggtttctccagaatgatggcaacactggaggtgaacccaccagagcaaaggattggtcaatgcactggctgccatctagaatgcataaatgggggtgtgaggctaatcactctaaccagtgagctcaggtcagctactgtctgtgcttcccacttttgcagttctgcctcaagtggtaagaaaagcacggagattcatttccactcaggatcattggttgggaaaacagctatccatgtcaaaggggcattggtagatggaactgagttcacatttgagggtagttgcatgttcccagatggatgtgatgcagtggactgcacattctgtcgtgagtttctaaaaaatcctcagtgctaccctgcaaagaagtggctgttcatcattattgtcatcctccttggatatgcaggcctcatgttactcaccaatgtccttaaggcaattggggtctggggatcatgggtaatagctccagtgaagctaatgtttgccatcataaagaaactaatgagaactgtgagctgcttggtggggaaattgatggataggggaaggcaagtgatccatgaggaaataggggagaatggggagggcaaccaagatgatgttaggattgagatggcaagacccagaagggtaaggcattggatgtactcacctgtcatcctgaccattctagcaatagggcttgcagagggctgtgatgagatggtccatgctgattctaaacttgtttcatgcagacaagggagcggaaacatgaaggaatgcataacaactgggagggcgcttcttcctgcggtgaacccaggacaagaggcatgtctgcacttcacagcacctgggagtccggactcaaaatgtctcaaaattaaggttaagaggatcaacctaaaatgtaagaagtcatcatcatattttgttcctgatgcccggtccaggtgtacatcagtgaggagatgtcgttgggcgggagactgccagtctgggtgcccccctcatttcacatccaactccttttctgatgattgggcaggtaagatggacagggctggtcttggattcagtggctgctctgatggatgtggaggagcagcctgcggctgctttaatgcggccccttcatgcatcttctggaggaaatgggtggagaatccacatgggatcatctggaaagtgtctccatgcgccgcatgggtcccatcagcagttatagagctaacaatgccctcaggtgaggtgaggacattccaccccatgagcggcatccccacacaggtcttcaagggtgtgagtgtaacttacttgggctcagatatggaggtgtctggcttgactgacctgtgtgagatagaagaactcaagtccaaaaagctggcattagctccctgcaaccaggctggcatgggggttgtaggcaaggttggagagatacagtgcagtagcgaggagagtgcccgtaccataaaaaaagatgggtgcatatggaacgcagacctcgtgggtatagagctacgagtggatgacgctgtgtgctactctaagattacaagtgtggaggcagttgcaaactactctgccatacccaccactattggggggctgaggtttgagagaagccatgacagccagggtaaaatatctggtagccccctggacatcacagctataagaggatccttttctgttaattatagaggccttcgattaagtctctcagaaattactgctacttgcacaggggaggtgacaaatgtgagtgggtgctattcctgcatgacaggtgccaaagtctccatcaaattgcatagcagcaaaaatagcactgcccatgttagatgcaaaggggatgagactgcattcagtgtcttggagggagtccatagctacattgtccgcctcagctttgaccatgcagtagtcgatgagcaatgccagctgaactgtgggggacatgagagtcaagtgactcttaaaggcaacctcatcttcctggatgtcccaaaatttgtggatggcagctacatgcagacatatcacagtactgtgccaacaggggcaaatatcccaagccctacagattggctgaatgccttgtttggcaatgggctgagtaggtggatcctgggggtgataggggttctactggggggattggctctctttttcttgatcatgtttttgctcaagctgggaacaaaacaggtatttcgatcgaggacgaagctggcttagggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17473 - RNA, 1120 nt, synthetic construct
  misc_feature 1..1120: note = mRNA product Design2 comprising derived and/or modified sequence from SFTSV(HB29)__NC_018137.1__N (opt4)
  source 1..1120: mol_type = other RNA
ggggcgctgcctacggaggtggcagccatctccttctcggcatcaagcttaccatgagcgagtggagcagaatcgccgtggagttcggcgagcagcagctgaacctgaccgagctggaggacttcgccagagagctggcctacgagggcctggaccccgccctgatcatcaagaagctgaaggagaccggcggcgacgactgggtgaaggacaccaagttcatcatcgtgttcgccctgaccagaggcaacaagatcgtgaaggccagcggcaagatgagcaacagcggcagcaagagactgatggccctgcaggagaagtacggcctggtggagagagccgagaccagactgagcatcacccccgtgagagtggcccagagcctgcccacctggacctgcgccgccgccgccgccctgaaggagtacctgcccgtgggccccgccgtgatgaacctgaaggtggagaactacccccccgagatgatgtgcatggccttcggcagcctgatccccaccgccggcgtgagcgaggccaccaccaagaccctgatggaggcctacagcctgtggcaggacgccttcaccaagaccatcaacgtgaagatgagaggcgccagcaagaccgaggtgtacaacagcttcagagaccccctgcacgccgccgtgaacagcgtgttcttccccaacgacgtgagagtgaagtggctgaaggccaagggcatcctgggccccgacggcgtgcccagcagagccgccgaggtggccgccgccgcctacagaaacctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17474 - RNA, 3604 nt, synthetic construct
  misc_feature 1..3604: note = mRNA product Design2 comprising derived and/or modified sequence from SFTSV(HB29)__NC_018138.1__GP (opt4)
  source 1..3604: mol_type = other RNA
ggggcgctgcctacggaggtggcagccatctccttctcggcatcaagcttaccatgatgaaggtgatctggttcagcagcctgatctgcctggtgatccagtgcagcggcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcaccagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagactgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17475 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (opt4)
  source 1..3601: mol_type = other RNA
ggggcgctgcctacggaggtggcagccatctccttctcggcatcaagcttaccatggactggacctggatcctgttcctggtggccgccgccaccagagtgcacagcgacagcggccccatcatctgcgccggccccatccacagcaacaagagcgccggcatcccccacctgctgggctacagcgagaagatctgccagatcgacagactgatccacgtgagcagctggctgagaaaccacagccagttccagggctacgtgggccagagaggcggcagaagccaggtgagctactaccccgccgagaacagctacagcagatggagcggcctgctgagcccctgcgacgccgactggctgggcatgctggtggtgaagaaggccaaggagagcgacatgatcgtgcccggccccagctacaagggcaaggtgttcttcgagagacccaccttcgacggctacgtgggctggggctgcggcagcggcaagagcagaaccgagagcggcgagctgtgcagcagcgacagcggcaccagcagcggcctgctgcccagcgacagagtgctgtggatcggcgacgtggcctgccagcccatgacccccatccccgaggagaccttcctggagctgaagagcttcagccagagcgagttccccgacatctgcaagatcgacggcatcgtgttcaaccagtgcgagggcgagagcctgccccagcccttcgacgtggcctggatggacgtgggccacagccacaagatcatcatgagagagcacaagaccaagtgggtgcaggagagcagcagcaaggacttcgtgtgctacaaggagggcaccggcccctgcagcgagagcgaggagaaggcctgcaagaccagcggcagctgcagaggcgacatgcagttctgcaaggtggccggctgcgagcacggcgaggaggccagcgaggccaagtgcagatgcagcctggtgcacaagcccggcgaggtggtggtgagctacggcggcaccagagtgagacccaagtgctacggcttcagcagaatgatggccaccctggaggtgaacccccccgagcagagaatcggccagtgcaccggctgccacctggagtgcatcaacggcggcgtgagactgatcaccctgaccagcgagctgagaagcgccaccgtgtgcgccagccacttctgcagcagcgccagcagcggcaagaagagcaccgagatccacttccacagcggcagcctggtgggcaagaccgccatccacgtgaagggcgccctggtggacggcaccgagttcaccttcgagggcagctgcatgttccccgacggctgcgacgccgtggactgcaccttctgcagagagttcctgaagaacccccagtgctaccccgccaagaagtggctgttcatcatcatcgtgatcctgctgggctacgccggcctgatgctgctgaccaacgtgctgaaggccatcggcgtgtggggcagctgggtgatcgcccccgtgaagctgatgttcgccatcatcaagaagctgatgagaaccgtgagctgcctggtgggcaagctgatggacagaggcagacaggtgatccacgaggagatcggcgagaacggcgagggcaaccaggacgacgtgagaatcgagatggccagacccagaagagtgagacactggatgtacagccccgtgatcctgaccatcctggccatcggcctggccgagggctgcgacgagatggtgcacgccgacagcaagctggtgagctgcagacagggcagcggcaacatgaaggagtgcatcaccaccggcagagccctgctgcccgccgtgaaccccggccaggaggcctgcctgcacttcaccgcccccggcagccccgacagcaagtgcctgaagatcaaggtgaagagaatcaacctgaagtgcaagaagagcagcagctacttcgtgcccgacgccagaagcagatgcaccagcgtgagaagatgcagatgggccggcgactgccagagcggctgccccccccacttcaccagcaacagcttcagcgacgactgggccggcaagatggacagagccggcctgggcttcagcggctgcagcgacggctgcggcggcgccgcctgcggctgcttcaacgccgcccccagctgcatcttctggagaaagtgggtggagaacccccacggcatcatctggaaggtgagcccctgcgccgcctgggtgcccagcgccgtgatcgagctgaccatgcccagcggcgaggtgagaaccttccaccccatgagcggcatccccacccaggtgttcaagggcgtgagcgtgacctacctgggcagcgacatggaggtgagcggcctgaccgacctgtgcgagatcgaggagctgaagagcaagaagctggccctggccccctgcaaccaggccggcatgggcgtggtgggcaaggtgggcgagatccagtgcagcagcgaggagagcgccagaaccatcaagaaggacggctgcatctggaacgccgacctggtgggcatcgagctgagagtggacgacgccgtgtgctacagcaagatcaccagcgtggaggccgtggccaactacagcgccatccccaccaccatcggcggcctgagattcgagagaagccacgacagccagggcaagatcagcggcagccccctggacatcaccgccatcagaggcagcttcagcgtgaactacagaggcctgagactgagcctgagcgagatcaccgccacctgcaccggcgaggtgaccaacgtgagcggctgctacagctgcatgaccggcgccaaggtgagcatcaagctgcacagcagcaagaacagcaccgcccacgtgagatgcaagggcgacgagaccgccttcagcgtgctggagggcgtgcacagctacatcgtgagactgagcttcgaccacgccgtggtggacgagcagtgccagctgaactgcggcggccacgagagccaggtgaccctgaagggcaacctgatcttcctggacgtgcccaagttcgtggacggcagctacatgcagacctaccacagcaccgtgcccaccggcgccaacatccccagccccaccgactggctgaacgccctgttcggcaacggcctgagcagatggatcctgggcgtgatcggcgtgctgctgggcggcctggccctgttcttcctgatcatgttcctgctgaagctgggcaccaagcaggtgttcagaagcagaaccaagctggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17476 - RNA, 1120 nt, synthetic construct
  misc_feature 1..1120: note = mRNA product Design2 comprising derived and/or modified sequence from SFTSV(HB29)__NC_018137.1__N (opt3)
  source 1..1120: mol_type = other RNA
ggggcgctgcctacggaggtggcagccatctccttctcggcatcaagcttaccatgagcgagtggtccagaatcgccgtggagttcggcgaacagcaactgaacctcaccgaacttgaggactttgctagggaactggcatacgaggggttggatcccgccttaattataaagaaactgaaggagacaggaggtgacgattgggtcaaagacactaagttcatcattgtttttgcgctaacgcggggcaataaaatcgtgaaggcttctgggaagatgtcaaacagtggaagcaaacgcctcatggccctgcaggaaaagtatggccttgtagagcgagcagaaacccgtctgtccattacacctgtgagagtcgcccagtctttgccaacttggacctgcgctgcagccgctgccctcaaagagtacctgccggtgggtcccgcggttatgaatctgaaggtggagaactatcctccagaaatgatgtgtatggcattcgggtcgctcatccccacagccggagtctcagaggctaccactaaaacattaatggaagcctacagcctgtggcaggatgcatttaccaagacgataaatgtgaagatgaggggcgctagtaaaactgaggtatataactccttccgggaccctcttcacgccgcggttaattctgtgtttttcccaaacgatgtccgcgtgaagtggttgaaagccaagggcatcctggggcccgacggagtgcctagcagagcagctgaagtcgccgctgccgcatacaggaatctatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17477 - RNA, 3604 nt, synthetic construct
  misc_feature 1..3604: note = mRNA product Design2 comprising derived and/or modified sequence from SFTSV(HB29)__NC_018138.1__GP (opt3)
  source 1..3604: mol_type = other RNA
ggggcgctgcctacggaggtggcagccatctccttctcggcatcaagcttaccatgatgaaggtgatctggttcagctccctgatttgcctcgtcatacagtgttctggcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggacaagggtgcggcccaaatgttacggcttcagtcgcatgatggccaccctggaggtcaaccctccagaacagcgaatcggacaatgcactggctgtcaccttgagtgcatcaatgggggagtgagattgattacactgaccagcgagctaaggtccgctacggtttgtgcctctcatttttgctcgagcgcgtcctcaggtaagaagagtactgaaatacacttccactctggcagcctcgtggggaaaaccgcaatccatgtcaagggagccctggtggacggcacagagttcacttttgaaggttcctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcatgggtgatcgcccccgtcaaacttatgttcgcgattatcaagaagctgatgcgtaccgtgagctgtttggttggaaaactaatggaccgcggtagacaggtgattcacgaagagataggcgagaacggggaaggaaatcaagatgacgtaaggatcgagatggcccggccacgacgcgtcagacattggatgtattctcctgtgattctgacgatcctcgcaatcggcctggctgaaggttgcgatgagatggttcacgccgactccaaacttgtgagttgtaggcaggggagcggcaacatgaaggagtgcattactacaggacgggctctgttgcccgccgtcaatccaggccaggaagcatgtctccattttaccgcccccgggtctcctgattccaagtgcctgaagataaaagtgaagcgcatcaacttaaaatgtaagaaatcaagtagctacttcgtaccagacgctagatcgaggtgcacttccgtgcgtcggtgtcgatgggcgggagattgccagtctggctgcccgccccactttacaagcaattcattcagtgacgactgggcaggtaagatggatagagccgggctgggattttccggctgttctgacggttgcggcggggctgcctgtggatgcttcaacgcagcccctagctgtatcttttggaggaagtgggttgagaatccacacggcattatttggaaagtctccccctgcgctgcctgggtgccttcagcagtgatcgaactaaccatgccaagcggggaggtccgcacgttccatcccatgagtggaataccgacccaagttttcaagggcgtgtctgtgacatatctcggttccgatatggaagtaagcgggctgactgacctttgtgagatcgaggaattgaaatcgaagaaactggcgctcgctccttgcaaccaggccggaatgggcgtcgtgggtaaggttggcgagattcagtgttcatctgaagagagtgcacggaccatcaaaaaggatgggtgcatttggaacgccgacctggtgggaatcgaacttagagtcgatgacgctgtgtgttactccaagataacaagcgttgaggccgtggcaaattattctgctattccaactaccatcggcgggctgaggtttgagcgcagccacgattcccagggaaaaatttcaggcagtcccttggacatcacagccatacgaggtagcttctctgtaaactaccgggggctccgtctgtccttatcagaaatcaccgcgacttgcacgggagaggtcacaaatgtgagtggctgctacagctgtatgaccggtgccaaggtgtccattaaactgcattcttcgaagaacagcactgctcacgtcagatgcaaaggcgatgaaaccgcattttcagttctagagggggtgcactcctatatcgtaaggctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaaactgggaaccaagcaagtgtttcggagcagaactaaacttgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17478 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (opt3)
  source 1..3601: mol_type = other RNA
ggggcgctgcctacggaggtggcagccatctccttctcggcatcaagcttaccatggactggacctggatcctgttcctcgtggccgctgcaacaagagtccacagcgactcagggcccatcatttgcgccggacctatccacagtaacaaaagcgctggtattccacatcttctgggctactccgagaagatctgtcaaatagatagattgatccacgtttcttcgtggttaaggaatcattcacagtttcaggggtatgtgggacagcggggcggtcgcagccaagtaagttactatccggcagaaaactcctactctcgatggagcgggctgctatccccctgcgacgccgattggctcggaatgctggtggtcaaaaaggcgaaagagtcagacatgattgtgcctggcccaagttataagggcaaggttttctttgaacgtcccaccttcgatgggtacgtgggatggggttgtggcagcgggaaatctagaacagagtccggagaactttgctcaagcgacagtggcacttcttccggtctgttgcctagcgatagggtcctctggatcggggacgtggcttgtcagccaatgacgcccattcctgaggagacctttctggaactgaagtcgttctctcagtccgagtttccagatatctgcaaaatagacggaattgtattcaatcagtgtgaaggcgagtcactcccgcaaccctttgatgttgcctggatggacgtgggccacagtcataagatcattatgcgggagcacaaaacaaagtgggtccaggaaagctcctctaaggatttcgtgtgctataaagaggggactggaccttgtagcgaatcagaggaaaaggcatgcaaaaccagtggttcctgccgcggcgacatgcagttttgtaaggtggccgggtgcgagcacggagaggaagctagcgaggcaaaatgtagatgctctttagtccataagccaggcgaagttgtggtatcatacggtgggacaagggtgcggcccaaatgttacggcttcagtcgcatgatggccaccctggaggtcaaccctccagaacagcgaatcggacaatgcactggctgtcaccttgagtgcatcaatgggggagtgagattgattacactgaccagcgagctaaggtccgctacggtttgtgcctctcatttttgctcgagcgcgtcctcaggtaagaagagtactgaaatacacttccactctggcagcctcgtggggaaaaccgcaatccatgtcaagggagccctggtggacggcacagagttcacttttgaaggttcctgtatgttccccgatgggtgcgacgctgtagattgcaccttttgtcgggagttccttaaaaacccgcagtgctatcctgccaagaaatggctgtttattatcatagttattttgctcggctacgcaggactgatgttactgacaaatgtgctcaaggctatcggcgtctgggggtcatgggtgatcgcccccgtcaaacttatgttcgcgattatcaagaagctgatgcgtaccgtgagctgtttggttggaaaactaatggaccgcggtagacaggtgattcacgaagagataggcgagaacggggaaggaaatcaagatgacgtaaggatcgagatggcccggccacgacgcgtcagacattggatgtattctcctgtgattctgacgatcctcgcaatcggcctggctgaaggttgcgatgagatggttcacgccgactccaaacttgtgagttgtaggcaggggagcggcaacatgaaggagtgcattactacaggacgggctctgttgcccgccgtcaatccaggccaggaagcatgtctccattttaccgcccccgggtctcctgattccaagtgcctgaagataaaagtgaagcgcatcaacttaaaatgtaagaaatcaagtagctacttcgtaccagacgctagatcgaggtgcacttccgtgcgtcggtgtcgatgggcgggagattgccagtctggctgcccgccccactttacaagcaattcattcagtgacgactgggcaggtaagatggatagagccgggctgggattttccggctgttctgacggttgcggcggggctgcctgtggatgcttcaacgcagcccctagctgtatcttttggaggaagtgggttgagaatccacacggcattatttggaaagtctccccctgcgctgcctgggtgccttcagcagtgatcgaactaaccatgccaagcggggaggtccgcacgttccatcccatgagtggaataccgacccaagttttcaagggcgtgtctgtgacatatctcggttccgatatggaagtaagcgggctgactgacctttgtgagatcgaggaattgaaatcgaagaaactggcgctcgctccttgcaaccaggccggaatgggcgtcgtgggtaaggttggcgagattcagtgttcatctgaagagagtgcacggaccatcaaaaaggatgggtgcatttggaacgccgacctggtgggaatcgaacttagagtcgatgacgctgtgtgttactccaagataacaagcgttgaggccgtggcaaattattctgctattccaactaccatcggcgggctgaggtttgagcgcagccacgattcccagggaaaaatttcaggcagtcccttggacatcacagccatacgaggtagcttctctgtaaactaccgggggctccgtctgtccttatcagaaatcaccgcgacttgcacgggagaggtcacaaatgtgagtggctgctacagctgtatgaccggtgccaaggtgtccattaaactgcattcttcgaagaacagcactgctcacgtcagatgcaaaggcgatgaaaccgcattttcagttctagagggggtgcactcctatatcgtaaggctcagtttcgaccatgccgtggtcgatgaacaatgtcagctgaattgcggaggccacgagtctcaggtgacacttaaggggaacttgatttttctggacgttcctaagttcgtggacggaagctacatgcagacctatcattccactgtccccacaggcgctaatatcccatcacctacggattggctcaacgccctgtttggtaatgggttatctcgctggatactgggagtgattggcgttcttttgggcgggctcgcactgttctttctaatcatgttcctgctcaaactgggaaccaagcaagtgtttcggagcagaactaaacttgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17479 - RNA, 1120 nt, synthetic construct
  misc_feature 1..1120: note = mRNA product Design2 comprising derived and/or modified sequence from SFTSV(HB29)__NC_018137.1__N (opt1)
  source 1..1120: mol_type = other RNA
ggggcgctgcctacggaggtggcagccatctccttctcggcatcaagcttaccatgagcgagtggtcccgcatcgccgtggagttcggcgagcagcagctgaacctcaccgagctggaggacttcgcccgggagctggcgtacgaggggctcgaccccgccctgatcatcaagaagctgaaggagaccggcggggacgactgggtcaaggacacgaagttcatcatcgtgttcgccctcacccgcggcaacaagatcgtgaaggccagcgggaagatgtccaacagcggctccaagcggctgatggccctgcaggagaagtacggcctcgtcgagcgcgcggagacccggctgagcatcaccccggtgcgcgtggcccagtccctgcccacgtggacctgcgccgccgcggccgccctcaaggagtacctgcccgtcgggcccgccgtgatgaacctgaaggtggagaactacccgcccgagatgatgtgcatggccttcggcagcctcatccccaccgcgggggtctccgaggccaccacgaagaccctgatggaggcctacagcctgtggcaggacgccttcaccaagaccatcaacgtgaagatgcggggcgcctccaagacggaggtgtacaacagcttccgcgaccccctccacgcggccgtcaactccgtgttcttcccgaacgacgtgcgggtcaagtggctgaaggccaaggggatcctgggccccgacggcgtgcccagccgcgccgccgaggtggcggccgccgcctaccggaacctctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17480 - RNA, 3604 nt, synthetic construct
  misc_feature 1..3604: note = mRNA product Design2 comprising derived and/or modified sequence from SFTSV(HB29)__NC_018138.1__GP (opt1)
  source 1..3604: mol_type = other RNA
ggggcgctgcctacggaggtggcagccatctccttctcggcatcaagcttaccatgatgaaggtgatctggttcagctccctgatctgcctcgtcatccagtgcagcggcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcacccgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccagctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcatcacgaccggccgcgccctgctgcccgccgtgaaccccgggcaggaggcctgcctccacttcaccgcccccggcagcccggacagcaagtgcctgaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccacgaccatcggcggcctccgcttcgagcggagccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacatcgtgcggctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17481 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (opt1)
  source 1..3601: mol_type = other RNA
ggggcgctgcctacggaggtggcagccatctccttctcggcatcaagcttaccatggactggacctggatcctgttcctcgtggccgccgcgacccgcgtccacagcgactccgggcccatcatctgcgccggcccgatccacagcaacaagtccgccgggatcccccacctcctgggctacagcgagaagatctgccagatcgaccgcctgatccacgtgtccagctggctgcggaaccactcccagttccaggggtacgtgggccagcgcggcgggcggagccaggtctcctactaccccgcggagaacagctactcccgctggagcggcctgctctccccctgcgacgccgactggctggggatgctggtggtgaagaaggccaaggagagcgacatgatcgtcccgggcccctcctacaaggggaaggtgttcttcgagcggcccaccttcgacggctacgtgggctgggggtgcggcagcgggaagtcccgcaccgagagcggcgagctctgcagctccgacagcggcacgtccagcgggctgctgccctccgaccgggtcctctggatcggcgacgtggcctgccagccgatgacccccatccccgaggagaccttcctggagctcaagagcttctcccagagcgagttccccgacatctgcaagatcgacgggatcgtgttcaaccagtgcgagggcgagtccctgccgcagcccttcgacgtcgcctggatggacgtggggcacagccacaagatcatcatgcgcgagcacaagaccaagtgggtgcaggagtccagctccaaggacttcgtctgctacaaggagggcacgggcccctgcagcgagtccgaggagaaggcgtgcaagaccagcgggtcctgccggggcgacatgcagttctgcaaggtggccgggtgcgagcacggcgaggaggccagcgaggccaagtgccgctgctccctggtgcacaagcccggggaggtcgtggtgagctacggcggcacccgggtccgcccgaagtgctacgggttcagccggatgatggcgaccctggaggtgaacccgcccgagcagcgcatcggccagtgcacggggtgccacctcgagtgcatcaacggcggggtgcggctgatcaccctgacctccgagctccgcagcgccaccgtctgcgcctcccacttctgcagctccgccagctccggcaagaagtccacggagatccacttccactccggcagcctggtggggaagaccgccatccacgtcaagggcgcgctggtggacgggaccgagttcaccttcgagggctcctgcatgttccccgacggctgcgacgccgtggactgcacgttctgccgggagttcctcaagaacccccagtgctaccccgccaagaagtggctgttcatcatcatcgtcatcctgctcgggtacgccggcctgatgctgctcaccaacgtgctgaaggccatcggggtgtggggcagctgggtcatcgcgcccgtgaagctgatgttcgccatcatcaagaagctcatgcgcaccgtgtcctgcctggtcgggaagctgatggaccggggccgccaggtgatccacgaggagatcggcgagaacggggagggcaaccaggacgacgtgcggatcgagatggcccgcccccgccgggtccgccactggatgtacagcccggtgatcctcaccatcctggccatcgggctggccgagggctgcgacgagatggtgcacgcggactccaagctcgtcagctgccggcaggggtccggcaacatgaaggagtgcatcacgaccggccgcgccctgctgcccgccgtgaaccccgggcaggaggcctgcctccacttcaccgcccccggcagcccggacagcaagtgcctgaagatcaaggtgaagcggatcaacctgaagtgcaagaagtccagctcctacttcgtccccgacgcgcgcagccggtgcacctccgtgcgccggtgccgctgggccggggactgccagagcggctgcccgccccacttcacgtccaacagcttctccgacgactgggccgggaagatggaccgggccggcctcggcttcagcgggtgctccgacggctgcgggggcgcggcctgcgggtgcttcaacgccgcccccagctgcatcttctggcgcaagtgggtggagaacccccacggcatcatctggaaggtctccccctgcgccgcgtgggtgccgagcgccgtgatcgagctgaccatgccctccggcgaggtccggaccttccaccccatgagcgggatccccacccaggtgttcaagggcgtgtccgtcacgtacctggggagcgacatggaggtgtccggcctcaccgacctgtgcgagatcgaggagctcaagagcaagaagctggccctggccccgtgcaaccaggccggcatgggggtggtcggcaaggtgggggagatccagtgcagctccgaggagagcgcgcgcaccatcaagaaggacggctgcatctggaacgccgacctggtggggatcgagctgcgggtcgacgacgccgtgtgctactccaagatcaccagcgtggaggccgtcgccaactactccgcgatccccacgaccatcggcggcctccgcttcgagcggagccacgactcccaggggaagatcagcggcagccccctggacatcaccgccatccgcgggagcttctccgtgaactaccggggcctgcgcctcagcctgtccgagatcaccgccacgtgcaccggggaggtgaccaacgtcagcggctgctactcctgcatgaccggcgccaaggtgagcatcaagctgcactccagcaagaactccaccgcgcacgtgcgctgcaagggggacgagacggccttcagcgtcctcgagggcgtgcacagctacatcgtgcggctgtccttcgaccacgccgtcgtggacgagcagtgccagctgaactgcgggggccacgagagccaggtgaccctcaaggggaacctgatcttcctggacgtccccaagttcgtggacggctcctacatgcagacctaccacagcaccgtgccgacgggcgccaacatcccctcccccaccgactggctcaacgccctgttcgggaacggcctgagccgctggatcctcggggtcatcggcgtgctgctgggcgggctcgcgctgttcttcctgatcatgttcctcctgaagctgggcaccaagcaggtcttccggtcccgcaccaagctcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17482 - RNA, 1120 nt, synthetic construct
  misc_feature 1..1120: note = mRNA product Design2 comprising derived and/or modified sequence from SFTSV(HB29)__NC_018137.1__N (opt5)
  source 1..1120: mol_type = other RNA
ggggcgctgcctacggaggtggcagccatctccttctcggcatcaagcttaccatgagcgagtggtccagaatcgccgtggagttcggcgaacagcaactgaacctcaccgaactggaggactttgctcgggaacttgcctacgaggggctggatcccgcgctcattatcaagaaactgaaggagacaggaggcgacgattgggtcaaagacacgaagttcattatcgtttttgctcttacccgcgggaataaaattgtgaaggcctctggaaagatgagcaactccggctctaaaagactgatggccctccaggaaaagtatgggctggtggagcgggctgaaacacgcctgagcatcacccctgtcagagtggcccagtccctcccgacatggacctgcgctgccgcggccgctctgaaagagtaccttcccgttggacctgccgtgatgaatctgaaggtcgagaactatccccctgaaatgatgtgtatggctttcggctctctcatccccacagccggcgtgagcgaggcgaccacgaaaaccctgatggaagcctactccctttggcaggatgcttttacaaagaccattaatgttaagatgcgcggggccagcaaaacagaggtgtataactctttccgggaccctctgcacgctgccgtcaattccgtgtttttcccgaacgatgtgagagtcaagtggctcaaagccaagggaatcctgggccccgacggggttcctagccgggctgcggaagtggccgctgccgcctaccgcaatctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17483 - RNA, 3604 nt, synthetic construct
  misc_feature 1..3604: note = mRNA product Design2 comprising derived and/or modified sequence from SFTSV(HB29)__NC_018138.1__GP (opt5)
  source 1..3604: mol_type = other RNA
ggggcgctgcctacggaggtggcagccatctccttctcggcatcaagcttaccatgatgaaggtgatctggttcagctccctgatttgcctcgtcatccagtgttctggcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaggcttctgaagccaaatgtcggtgctccctggtgcataagcctggggaagtggtcgtgagctacggaggcacacgcgttagacccaaatgttacgggttctcccggatgatggcgacccttgaggtgaaccctcccgaacagcgcatcggacaatgcacgggctgtcacctggagtgcattaatgggggcgtcagactcatcaccctgacatctgagctgcggagcgccaccgtgtgtgcttcccatttttgctctagcgcctccagcggaaagaagtctacagaaattcacttccactccggcagcctcgttgggaaaaccgctatccatgtgaagggagccctggtcgacggcacggagttcacatttgaagggtcttgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcctgggtgattgctcccgtcaagctgatgttcgccatcatcaaaaagctcatgagaaccgtgagctgtctggttggcaaacttatggaccgggggagacaggtgattcacgaagagatcggagagaacggcgaagggaatcaagatgacgtccgcattgagatggcccggcctagacgcgtgcggcattggatgtattctcccgtgatcctgaccattctcgctatcggactggcggaaggctgcgatgagatggttcacgccgacagcaagctggtctcctgtagacaggggagcggcaacatgaaagagtgcattacaacgggacgcgctctgctccctgccgtgaatcccggccaggaagcctgtctgcattttaccgctccggggtctcctgattccaagtgcctgaagatcaaagtgaagcggatcaacctcaaatgtaagaaaagctcctcttacttcgtccccgacgccagaagccgctgcacatccgtgcggagatgtcgctgggcgggagattgccagtctggctgccctccccactttaccagcaattccttctctgacgactgggctgggaagatggatcgggccggactgggctttagcgggtgttccgacggctgcggaggcgccgcttgtgggtgcttcaacgccgctcctagctgtatcttttggagaaagtgggttgagaatccccacggaattatttggaaagtgtctccgtgcgccgcgtgggtcccttccgccgtgatcgaacttacaatgcccagcggcgaggttcggaccttccatcccatgtctgggattcctacgcaagtgttcaagggagtctccgtgacatatctgggcagcgatatggaagtttctggcctcaccgacctgtgtgagatcgaggaactgaaatccaagaaacttgctctcgccccgtgcaaccaggctgggatgggagtggtcggcaaggtgggggagatccagtgtagctccgaagagagcgcccgcaccattaaaaaggatggatgcatctggaacgcggacctggtgggcattgaactgagagtcgatgacgccgtttgttactctaagatcacaagcgtggaggctgtggccaattattccgctattcccaccacaatcgggggactccggtttgagagatctcacgatagccagggcaaaatctccggctctcctctggacattacggccatccgcgggagcttctccgtcaactaccggggacttagactgtctctcagcgaaattaccgccacatgcaccggcgaggtgacaaatgtttccgggtgctacagctgtatgaccggagctaaggtgtctatcaaactgcattccagcaagaactctacggcgcacgtccgctgcaaaggcgatgaaaccgccttttccgtgctggagggggttcacagctatattgtgagactttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaaactgggcacaaagcaagtttttcgctccagaaccaaacttgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17484 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (opt5)
  source 1..3601: mol_type = other RNA
ggggcgctgcctacggaggtggcagccatctccttctcggcatcaagcttaccatggactggacctggatcctgttcctcgtggccgctgccacaagagtccacagcgacagcgggcccattatctgcgccggacctattcactccaacaaatctgctggcatcccgcatctgcttgggtacagcgagaagatctgtcaaattgatagactgatccacgtttcctcttggctccggaatcatagccagtttcagggatatgtgggccagcgcgggggaagatcccaagtgagctactatcccgccgaaaactcttactcccggtggagcggcctgctttctccttgcgacgcggattggctgggcatgctcgtcgtgaaaaaggctaaagagtccgacatgattgttcccgggcctagctataagggaaaggtgttctttgaacgccccaccttcgatggctacgtcgggtggggatgtggctctgggaaatccagaacagagagcggagaactgtgctcctctgacagcggcacgtccagcggcctgctcccttctgatcgggtgctgtggatcggggacgttgcctgtcagccgatgacccccattcctgaggagacatttcttgaactgaagtccttcagccagtctgagtttcccgatatctgcaaaattgacggaatcgtgttcaatcagtgtgaaggcgagagcctccctcaaccctttgatgtcgcctggatggacgtggggcactcccataagatcattatgcgcgagcacaaaaccaagtgggtgcaggaatctagctccaaggatttcgtctgctataaagagggaacaggcccgtgtagcgaatctgaggaaaaggcttgcaaaacctccgggagctgcagaggagacatgcagttttgtaaggttgccggctgcgagcacggcgaggaggcttctgaagccaaatgtcggtgctccctggtgcataagcctggggaagtggtcgtgagctacggaggcacacgcgttagacccaaatgttacgggttctcccggatgatggcgacccttgaggtgaaccctcccgaacagcgcatcggacaatgcacgggctgtcacctggagtgcattaatgggggcgtcagactcatcaccctgacatctgagctgcggagcgccaccgtgtgtgcttcccatttttgctctagcgcctccagcggaaagaagtctacagaaattcacttccactccggcagcctcgttgggaaaaccgctatccatgtgaagggagccctggtcgacggcacggagttcacatttgaagggtcttgtatgttccccgatggatgcgacgcggtggattgcaccttttgtcgcgagttccttaaaaaccctcagtgctatccggccaagaaatggctgtttatcattatcgtcattctcctgggctacgctgggcttatgctgctcacaaatgtgctgaaggccatcggcgtttggggatcctgggtgattgctcccgtcaagctgatgttcgccatcatcaaaaagctcatgagaaccgtgagctgtctggttggcaaacttatggaccgggggagacaggtgattcacgaagagatcggagagaacggcgaagggaatcaagatgacgtccgcattgagatggcccggcctagacgcgtgcggcattggatgtattctcccgtgatcctgaccattctcgctatcggactggcggaaggctgcgatgagatggttcacgccgacagcaagctggtctcctgtagacaggggagcggcaacatgaaagagtgcattacaacgggacgcgctctgctccctgccgtgaatcccggccaggaagcctgtctgcattttaccgctccggggtctcctgattccaagtgcctgaagatcaaagtgaagcggatcaacctcaaatgtaagaaaagctcctcttacttcgtccccgacgccagaagccgctgcacatccgtgcggagatgtcgctgggcgggagattgccagtctggctgccctccccactttaccagcaattccttctctgacgactgggctgggaagatggatcgggccggactgggctttagcgggtgttccgacggctgcggaggcgccgcttgtgggtgcttcaacgccgctcctagctgtatcttttggagaaagtgggttgagaatccccacggaattatttggaaagtgtctccgtgcgccgcgtgggtcccttccgccgtgatcgaacttacaatgcccagcggcgaggttcggaccttccatcccatgtctgggattcctacgcaagtgttcaagggagtctccgtgacatatctgggcagcgatatggaagtttctggcctcaccgacctgtgtgagatcgaggaactgaaatccaagaaacttgctctcgccccgtgcaaccaggctgggatgggagtggtcggcaaggtgggggagatccagtgtagctccgaagagagcgcccgcaccattaaaaaggatggatgcatctggaacgcggacctggtgggcattgaactgagagtcgatgacgccgtttgttactctaagatcacaagcgtggaggctgtggccaattattccgctattcccaccacaatcgggggactccggtttgagagatctcacgatagccagggcaaaatctccggctctcctctggacattacggccatccgcgggagcttctccgtcaactaccggggacttagactgtctctcagcgaaattaccgccacatgcaccggcgaggtgacaaatgtttccgggtgctacagctgtatgaccggagctaaggtgtctatcaaactgcattccagcaagaactctacggcgcacgtccgctgcaaaggcgatgaaaccgccttttccgtgctggagggggttcacagctatattgtgagactttccttcgaccatgctgtcgtggatgaacaatgtcagctcaattgcggaggccacgagtctcaggttacactgaagggcaacctgatctttctcgacgtgcccaagttcgtcgacgggagctacatgcagacctatcattccacagtgcctaccggagccaatatccccagccctacggattggctgaacgccctttttggcaatgggctgtctcggtggattctcggagtgatcggcgtcctgcttgggggacttgctctcttctttctgattatgttcctgctcaaactgggcacaaagcaagtttttcgctccagaaccaaacttgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17485 - RNA, 1120 nt, synthetic construct
  misc_feature 1..1120: note = mRNA product Design2 comprising derived and/or modified sequence from SFTSV(HB29)__NC_018137.1__N (opt11)
  source 1..1120: mol_type = other RNA
ggggcgctgcctacggaggtggcagccatctccttctcggcatcaagcttaccatgagcgagtggtcgcgcatagccgtggagttcggcgaacaacaactcaacctaacagaattggaagacttcgcacgcgagctagcgtacgagggcctggacccggccctaatcatcaaaaagctaaaggaaacgggaggggacgactgggtaaaagacaccaaattcataatagtgttcgcgctaacgcgcgggaacaagatcgtgaaagcgagcggaaaaatgagcaacagcgggagcaagcgcctgatggcgcttcaggaaaagtacgggctcgtggaacgggccgagaccaggctctcgataacgcccgtgcgcgtggcacagagcctgcccacgtggacatgcgcagccgcagccgcactaaaagaatacctcccggtagggccagcggtcatgaacttgaaagtagaaaactacccgcccgagatgatgtgcatggccttcggctcgctaataccaacggccggggtctcggaagcgaccacgaaaacactcatggaagcgtactcactctggcaagacgccttcaccaaaaccataaacgtaaaaatgcgaggggcctcgaaaacggaagtgtacaacagctttcgcgaccccctgcacgcggccgtgaactcggtcttcttcccgaacgatgtaagggtcaagtggctgaaagcaaaagggatcctgggcccggacggggtcccgagcagggccgcggaagtggccgcagccgcgtacaggaacctgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17486 - RNA, 3604 nt, synthetic construct
  misc_feature 1..3604: note = mRNA product Design2 comprising derived and/or modified sequence from SFTSV(HB29)__NC_018138.1__GP (opt11)
  source 1..3604: mol_type = other RNA
ggggcgctgcctacggaggtggcagccatctccttctcggcatcaagcttaccatgatgaaagtaatatggttctcttccctcatatgcctagtcatccagtgcagcggcgactccgggcccatcatatgcgcaggccccatccacagcaacaaatcagcagggataccccacctcctcggatactcagagaaaatatgccaaatagacagattaatccacgtgagctcctggctgcggaaccactctcaattccaagggtacgtcggtcaacgagggggaagaagccaagtctcatactacccagcagaaaacagctactccagatggagcggattactatcgccttgcgacgcagactggctaggcatgctagtagtaaagaaagccaaagaatccgacatgatcgtgccaggcccctcttacaaaggaaaagtatttttcgaaaggccaacattcgacggatacgtcggctggggctgcggctccggaaaaagcaggactgagagcggggagctatgttcatcagacagcggcacgtcgagcggcctcctcccatcagaccgggtcctgtggatcggagacgtcgcctgccaacccatgaccccgataccagaagagacattcctagagctaaagagcttctcccaaagcgagttccccgacatatgcaaaatagacggcatagtcttcaatcaatgcgagggagaatccctccctcagcctttcgatgtcgcatggatggacgtggggcactcacataaaattatcatgcgagaacacaaaacgaaatgggtccaggaatccagcagcaaagatttcgtatgctataaagaaggaacaggaccctgctcagaatcagaggaaaaagcctgcaaaacctcaggctcgtgcagaggtgacatgcagttctgtaaagtcgccggatgcgaacacggggaagaagcaagcgaggccaaatgccgctgcagccttgtccacaagccaggagaagtagtcgtctcctacggcggcaccagggtccgccccaaatgctacggcttctccagaatgatggccaccctcgaagtcaacccgcccgaacaacgcatcggacaatgcacaggctgccacctcgaatgcataaacggcggagtgagactgatcaccctaacctccgagctccggagcgccaccgtgtgtgcatcccacttctgcagctccgcctcaagcggcaaaaagagtaccgaaatccacttccactcgggaagcctggtaggaaaaacagccatccatgtgaaaggagccctcgtagacggaacagagttcacattcgaaggaagctgcatgttccctgacggctgcgacgccgtagactgcaccttttgccgagagttcctcaaaaacccccaatgctatcccgccaagaaatggctttttatcataattgtaatcttgctcggctacgccggcctaatgctactcaccaacgtgctcaaagccataggagtatgggggtcatgggtcatcgccccagtgaaactaatgttcgcaataatcaaaaagctaatgcgaacggtatcatgcctagtcggaaaactaatggacagaggacgccaagtaatacacgaagaaatcggggagaacggggagggtaaccaggacgacgtccgaatagagatggcgaggccccggagagtgcgccactggatgtacagcccagtaatactaaccattctagccataggactggctgaaggatgtgatgaaatggtacatgccgatagcaaactggtatcctgccggcaaggatccggaaacatgaaggaatgcatcacaacagggagagccctgctaccggcagtaaaccctggacaagaagcatgcctgcactttaccgcgccggggagccccgacagcaaatgcctcaagataaaggtcaagcgaataaacctaaaatgcaagaaatctagcagttacttcgtaccagacgcaagaagcagatgcacctcagttcgacggtgccgctgggccggtgactgccagtccggctgtccgccccatttcacgagcaacagcttcagtgacgactgggcaggcaaaatggacagagctggactcggcttcagcggctgcagcgacggctgtgggggagcggcctgcgggtgctttaacgcagcacctagctgcatcttctggcgaaagtgggtcgaaaacccacacgggataatatggaaggtcagcccctgcgcagcatgggtaccatccgccgtcatagaattaacaatgccgtccggcgaagttcgcacattccatcccatgtcaggcataccaacccaggtctttaaaggcgtctcagtaacctacctaggatcagacatggaggtaagcggacttacagacctctgtgaaatagaggaactcaagagcaagaaactcgcactcgcgccttgcaaccaggcaggcatgggcgtagtcggcaaagttggggaaatccagtgctcaagcgaagaaagcgcccgcaccatcaagaaagacggatgcatctggaacgcggatctagtcggaatcgagctacgcgttgatgacgccgtatgctacagcaaaatcacctcagtagaggccgtcgcaaactactccgccatacccacaactataggcggtctcaggttcgagcgctcccacgactcccagggaaaaatatcaggctcgcccctagacataaccgccatccgaggctcattctcagtcaactaccgcggccttcgcctcagcctctccgaaattacggcaacctgcaccggagaagtaacgaacgtctcaggttgctattcgtgcatgaccggagccaaagtcagcataaaactgcactccagcaaaaactcaacagcgcacgtacgatgcaaaggcgacgaaacagcattctcagtacttgaaggagtccactcctacatcgttaggctatcctttgaccatgccgtcgtcgacgaacaatgtcaactaaactgcgggggacacgaatcgcaagtgactctaaaaggaaacctgatatttctcgacgtcccgaaattcgtagacgggtcttatatgcagacataccacagcacggtaccaactggagccaacataccatcacccacagactggctgaacgctctattcggaaacggcctctcaaggtggatactaggggtcataggcgttctcctaggaggcctcgcactattcttcctaatcatgtttctgctcaaactcggcacaaagcaagtattcagaagccgaactaaactagcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17487 - RNA, 3601 nt, synthetic construct
  misc_feature 1..3601: note = mRNA product Design2 comprising derived and/or modified sequence from SFTSV(HB29)__NC_018138.1__IgE-leader_Gn-Gc (opt11)
  source 1..3601: mol_type = other RNA
ggggcgctgcctacggaggtggcagccatctccttctcggcatcaagcttaccatggattggacgtggatactctttctcgtggccgcggccacgcgcgtgcactcggactccgggcccatcatatgcgcaggccccatccacagcaacaaatcagcagggataccccacctcctcggatactcagagaaaatatgccaaatagacagattaatccacgtgagctcctggctgcggaaccactctcaattccaagggtacgtcggtcaacgagggggaagaagccaagtctcatactacccagcagaaaacagctactccagatggagcggattactatcgccttgcgacgcagactggctaggcatgctagtagtaaagaaagccaaagaatccgacatgatcgtgccaggcccctcttacaaaggaaaagtatttttcgaaaggccaacattcgacggatacgtcggctggggctgcggctccggaaaaagcaggactgagagcggggagctatgttcatcagacagcggcacgtcgagcggcctcctcccatcagaccgggtcctgtggatcggagacgtcgcctgccaacccatgaccccgataccagaagagacattcctagagctaaagagcttctcccaaagcgagttccccgacatatgcaaaatagacggcatagtcttcaatcaatgcgagggagaatccctccctcagcctttcgatgtcgcatggatggacgtggggcactcacataaaattatcatgcgagaacacaaaacgaaatgggtccaggaatccagcagcaaagatttcgtatgctataaagaaggaacaggaccctgctcagaatcagaggaaaaagcctgcaaaacctcaggctcgtgcagaggtgacatgcagttctgtaaagtcgccggatgcgaacacggggaagaagcaagcgaggccaaatgccgctgcagccttgtccacaagccaggagaagtagtcgtctcctacggcggcaccagggtccgccccaaatgctacggcttctccagaatgatggccaccctcgaagtcaacccgcccgaacaacgcatcggacaatgcacaggctgccacctcgaatgcataaacggcggagtgagactgatcaccctaacctccgagctccggagcgccaccgtgtgtgcatcccacttctgcagctccgcctcaagcggcaaaaagagtaccgaaatccacttccactcgggaagcctggtaggaaaaacagccatccatgtgaaaggagccctcgtagacggaacagagttcacattcgaaggaagctgcatgttccctgacggctgcgacgccgtagactgcaccttttgccgagagttcctcaaaaacccccaatgctatcccgccaagaaatggctttttatcataattgtaatcttgctcggctacgccggcctaatgctactcaccaacgtgctcaaagccataggagtatgggggtcatgggtcatcgccccagtgaaactaatgttcgcaataatcaaaaagctaatgcgaacggtatcatgcctagtcggaaaactaatggacagaggacgccaagtaatacacgaagaaatcggggagaacggggagggtaaccaggacgacgtccgaatagagatggcgaggccccggagagtgcgccactggatgtacagcccagtaatactaaccattctagccataggactggctgaaggatgtgatgaaatggtacatgccgatagcaaactggtatcctgccggcaaggatccggaaacatgaaggaatgcatcacaacagggagagccctgctaccggcagtaaaccctggacaagaagcatgcctgcactttaccgcgccggggagccccgacagcaaatgcctcaagataaaggtcaagcgaataaacctaaaatgcaagaaatctagcagttacttcgtaccagacgcaagaagcagatgcacctcagttcgacggtgccgctgggccggtgactgccagtccggctgtccgccccatttcacgagcaacagcttcagtgacgactgggcaggcaaaatggacagagctggactcggcttcagcggctgcagcgacggctgtgggggagcggcctgcgggtgctttaacgcagcacctagctgcatcttctggcgaaagtgggtcgaaaacccacacgggataatatggaaggtcagcccctgcgcagcatgggtaccatccgccgtcatagaattaacaatgccgtccggcgaagttcgcacattccatcccatgtcaggcataccaacccaggtctttaaaggcgtctcagtaacctacctaggatcagacatggaggtaagcggacttacagacctctgtgaaatagaggaactcaagagcaagaaactcgcactcgcgccttgcaaccaggcaggcatgggcgtagtcggcaaagttggggaaatccagtgctcaagcgaagaaagcgcccgcaccatcaagaaagacggatgcatctggaacgcggatctagtcggaatcgagctacgcgttgatgacgccgtatgctacagcaaaatcacctcagtagaggccgtcgcaaactactccgccatacccacaactataggcggtctcaggttcgagcgctcccacgactcccagggaaaaatatcaggctcgcccctagacataaccgccatccgaggctcattctcagtcaactaccgcggccttcgcctcagcctctccgaaattacggcaacctgcaccggagaagtaacgaacgtctcaggttgctattcgtgcatgaccggagccaaagtcagcataaaactgcactccagcaaaaactcaacagcgcacgtacgatgcaaaggcgacgaaacagcattctcagtacttgaaggagtccactcctacatcgttaggctatcctttgaccatgccgtcgtcgacgaacaatgtcaactaaactgcgggggacacgaatcgcaagtgactctaaaaggaaacctgatatttctcgacgtcccgaaattcgtagacgggtcttatatgcagacataccacagcacggtaccaactggagccaacataccatcacccacagactggctgaacgctctattcggaaacggcctctcaaggtggatactaggggtcataggcgttctcctaggaggcctcgcactattcttcctaatcatgtttctgctcaaactcggcacaaagcaagtattcagaagccgaactaaactagcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17488 - DNA, 62 bp, synthetic construct
  misc_feature 1..62: note = 5'-UTR of human peroxisomal multifunctional enzyme type 2 lacking the 5'-terminal oligopyrimidine tract (HSD17B4)
  source 1..62: mol_type = other DNA
gtcccgcagtcggcgtccagcggctctgcttgttcgtgtgtgtgtcgttgcaggccttattc

SEQ ID NO: 17489 - RNA, 62 nt, synthetic construct
  misc_feature 1..62: note = 5'-UTR of human peroxisomal multifunctional enzyme type 2 lacking the 5'-terminal oligopyrimidine tract (HSD17B4) mRNA
  source 1..62: mol_type = other RNA
gtcccgcagtcggcgtccagcggctctgcttgttcgtgtgtgtgtcgttgcaggccttattc

SEQ ID NO: 17490 - DNA, 42 bp, synthetic construct
  misc_feature 1..42: note = 5'-UTR of human acid ceramidase lacking the 5'-terminal oligopyrimidine tract (ASAH1)
  source 1..42: mol_type = other DNA
gcctctgctggagtccggggagtggcgttggctgctagagcg

SEQ ID NO: 17491 - RNA, 42 nt, synthetic construct
  misc_feature 1..42: note = 5'-UTR of human acid ceramidase lacking the 5'-terminal oligopyrimidine tract (ASAH1) mRNA
  source 1..42: mol_type = other RNA
gcctctgctggagtccggggagtggcgttggctgctagagcg

SEQ ID NO: 17492 - DNA, 75 bp, synthetic construct
  misc_feature 1..75: note = 5'-UTR of human mitochondrial ATP synthase subunit alpha lacking the 5'-terminal oligopyrimidine tract (ATP5A1)
  source 1..75: mol_type = other DNA
gcggctcggccattttgtcccagtcagtccggaggctgcggctgcagaagtaccgcctgcggagtaactgcaaag

SEQ ID NO: 17493 - RNA, 75 nt, synthetic construct
  misc_feature 1..75: note = 5'-UTR of human mitochondrial ATP synthase subunit alpha lacking the 5'-terminal oligopyrimidine tract (ATP5A1) mRNA
  source 1..75: mol_type = other RNA
gcggctcggccattttgtcccagtcagtccggaggctgcggctgcagaagtaccgcctgcggagtaactgcaaag

SEQ ID NO: 17494 - DNA, 54 bp, synthetic construct
  misc_feature 1..54: note = 5'-UTR of mouse RIKEN cDNA 2010107E04 gene (Mp68, 2010107E04Rik)
  source 1..54: mol_type = other DNA
ctttcccattctgtagcagaatttggtgttgcctgtggtcttggtcccgcggag

SEQ ID NO: 17495 - RNA, 54 nt, synthetic construct
  misc_feature 1..54: note = 5'-UTR of mouse RIKEN cDNA 2010107E04 gene (Mp68, 2010107E04Rik) mRNA
  source 1..54: mol_type = other RNA
ctttcccattctgtagcagaatttggtgttgcctgtggtcttggtcccgcggag

SEQ ID NO: 17496 - DNA, 81 bp, synthetic construct
  misc_feature 1..81: note = 5'-UTR of mouse NADH dehydrogenase (ubiquinone) 1 alpha subcomplex, 4 (Ndufa4)
  source 1..81: mol_type = other DNA
gtccgctcagccaggttgcagaagcggcttagcgtgtgtcctaatcttctctctgcgtgtaggtaggcctgtgccgcaaac

SEQ ID NO: 17497 - RNA, 81 nt, synthetic construct
  misc_feature 1..81: note = 5'-UTR of mouse NADH dehydrogenase (ubiquinone) 1 alpha subcomplex, 4 (Ndufa4) mRNA
  source 1..81: mol_type = other RNA
gtccgctcagccaggttgcagaagcggcttagcgtgtgtcctaatcttctctctgcgtgtaggtaggcctgtgccgcaaac

SEQ ID NO: 17498 - DNA, 108 bp, synthetic construct
  misc_feature 1..108: note = 5'-UTR of mouse nitric oxide synthase interacting protein (Nosip)
  source 1..108: mol_type = other DNA
ctcctgtcgggcggaagtaggaggagtagagtttaaaaacagtactctttttccggttcgggacgtagttgaagcaacgacaagccggataaccgctcttgagacagg

SEQ ID NO: 17499 - RNA, 108 nt, synthetic construct
  misc_feature 1..108: note = 5'-UTR of mouse nitric oxide synthase interacting protein (Nosip) mRNA
  source 1..108: mol_type = other RNA
ctcctgtcgggcggaagtaggaggagtagagtttaaaaacagtactctttttccggttcgggacgtagttgaagcaacgacaagccggataaccgctcttgagacagg

SEQ ID NO: 17500 - DNA, 84 bp, synthetic construct
  misc_feature 1..84: note = 5'-UTR of mouse ribosomal protein L31 (Rpl31)
  source 1..84: mol_type = other DNA
cccgtgacccggaagttgtacggctacgcgactttccctcccacaaaccctcgcgcccttcctttcctacttgggcccggcaga

SEQ ID NO: 17501 - RNA, 84 nt, synthetic construct
  misc_feature 1..84: note = 5'-UTR of mouse ribosomal protein L31 (Rpl31) mRNA
  source 1..84: mol_type = other RNA
cccgtgacccggaagttgtacggctacgcgactttccctcccacaaaccctcgcgcccttcctttcctacttgggcccggcaga

SEQ ID NO: 17502 - DNA, 159 bp, synthetic construct
  misc_feature 1..159: note = 5'-UTR of mouse solute carrier family 7 (cationic amino acid transporter, y+ system), member 3 (Slc7a3)
  source 1..159: mol_type = other DNA
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 17503 - RNA, 159 nt, synthetic construct
  misc_feature 1..159: note = 5'-UTR of mouse solute carrier family 7 (cationic amino acid transporter, y+ system), member 3 (Slc7a3) mRNA
  source 1..159: mol_type = other RNA
gggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactaga

SEQ ID NO: 17504 - DNA, 102 bp, synthetic construct
  misc_feature 1..102: note = 5'-UTR of human tubulin beta 4B class Ivb (TUBB4B)
  source 1..102: mol_type = other DNA
atataagcgttggcggagcgtcggttgtagcactctgcgcgcccgctcttctgctgctgtttgtctacttcctcctgcttccccgccgccgccgccgccatc

SEQ ID NO: 17505 - RNA, 102 nt, synthetic construct
  misc_feature 1..102: note = 5'-UTR of human tubulin beta 4B class Ivb (TUBB4B) mRNA
  source 1..102: mol_type = other RNA
atataagcgttggcggagcgtcggttgtagcactctgcgcgcccgctcttctgctgctgtttgtctacttcctcctgcttccccgccgccgccgccgccatc

SEQ ID NO: 17506 - DNA, 222 bp, synthetic construct
  misc_feature 1..222: note = 5'-UTR of mouse ubiquilin 2 (Ubqln2)
  source 1..222: mol_type = other DNA
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 17507 - RNA, 222 nt, synthetic construct
  misc_feature 1..222: note = 5'-UTR of mouse ubiquilin 2 (Ubqln2) mRNA
  source 1..222: mol_type = other RNA
cggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgcc

SEQ ID NO: 17508 - DNA, 57 bp, synthetic construct
  misc_feature 1..57: note = 3'-UTR of human proteasome subunit beta 3 (PSMB3)
  source 1..57: mol_type = other DNA
ccctgttcccagagcccacttttttttctttttttgaaataaaatagcctgtctttc

SEQ ID NO: 17509 - RNA, 57 nt, synthetic construct
  misc_feature 1..57: note = 3'-UTR of human proteasome subunit beta 3 (PSMB3) mRNA
  source 1..57: mol_type = other RNA
ccctgttcccagagcccacttttttttctttttttgaaataaaatagcctgtctttc

SEQ ID NO: 17510 - DNA, 121 bp, synthetic construct
  misc_feature 1..121: note = 3'-UTR of human caspase 1 (CASP1)
  source 1..121: mol_type = other DNA
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 17511 - RNA, 121 nt, synthetic construct
  misc_feature 1..121: note = 3'-UTR of human caspase 1 (CASP1) mRNA
  source 1..121: mol_type = other RNA
aataaggaaactgtatgaatgtctgtgggcaggaagtgaagagatccttctgtaaaggtttttggaattatgtctgctgaataataaacttttttgaaataataaatctggtagaaaaatg

SEQ ID NO: 17512 - DNA, 137 bp, synthetic construct
  misc_feature 1..137: note = 3'-UTR of human cytochrome c oxidase subunit 6B1 (COX6B1)
  source 1..137: mol_type = other DNA
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 17513 - RNA, 137 nt, synthetic construct
  misc_feature 1..137: note = 3'-UTR of human cytochrome c oxidase subunit 6B1 (COX6B1) mRNA
  source 1..137: mol_type = other RNA
actggctgcatctccctttcctctgtcctccatccttctcccaggatggtgaagggggacctggtacccagtgatccccaccccaggatcctaaatcatgacttacctgctaataaaaactcattggaaaagtgaga

SEQ ID NO: 17514 - DNA, 353 bp, synthetic construct
  misc_feature 1..353: note = 3'-UTR of mouse GNAS (guanine nucleotide binding protein, alpha stimulating) complex locus (Gnas)
  source 1..353: mol_type = other DNA
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 17515 - RNA, 353 nt, synthetic construct
  misc_feature 1..353: note = 3'-UTR of mouse GNAS (guanine nucleotide binding protein, alpha stimulating) complex locus (Gnas) mRNA
  source 1..353: mol_type = other RNA
gaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagca

SEQ ID NO: 17516 - DNA, 133 bp, synthetic construct
  misc_feature 1..133: note = 3'-UTR of mouse NADH dehydrogenase (ubiquinone) 1 alpha subcomplex, 1 (Ndufa1)
  source 1..133: mol_type = other DNA
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 17517 - RNA, 133 nt, synthetic construct
  misc_feature 1..133: note = 3'-UTR of mouse NADH dehydrogenase (ubiquinone) 1 alpha subcomplex, 1 (Ndufa1) mRNA
  source 1..133: mol_type = other RNA
ggaagcattttcctggctgattaaaagaaattactcagctatggtcatctgttcctgttagaaggctatgcagcatattatatactatgcgcatgttatgaaatgcataataaaaaattttaaaaaatctaaa

SEQ ID NO: 17518 - DNA, 70 bp, synthetic construct
  misc_feature 1..70: note = 3'-UTR of human ribosomal protein S9 (RPS9)
  source 1..70: mol_type = other DNA
gtccacctgtccctcctgggctgctggattgtctcgttttcctgccaaataaacaggatcagcgctttac

SEQ ID NO: 17519 - RNA, 70 nt, synthetic construct
  misc_feature 1..70: note = 3'-UTR of human ribosomal protein S9 (RPS9) mRNA
  source 1..70: mol_type = other RNA
gtccacctgtccctcctgggctgctggattgtctcgttttcctgccaaataaacaggatcagcgctttac

SEQ ID NO: 17520-17521 - skipped (2 entries)

SEQ ID NO: 17522 - RNA, 99 nt, synthetic construct
  misc_feature 1..99: note = mRNA 3'-end A75-histoneSL
  source 1..99: mol_type = other RNA
aaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 17523 - RNA, 102 nt, synthetic construct
  misc_feature 1..102: note = mRNA 3'-end U3-A75-histoneSL
  source 1..102: mol_type = other RNA
tttaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 17524 - RNA, 178 nt, synthetic construct
  misc_feature 1..178: note = mRNA 3'-end A154-histoneSL
  source 1..178: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 17525 - RNA, 181 nt, synthetic construct
  misc_feature 1..181: note = mRNA 3'-end U3-A154-histoneSL
  source 1..181: mol_type = other RNA
tttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 17526 - RNA, 101 nt, synthetic construct
  misc_feature 1..101: note = mRNA 3'-end N2-A75-histoneSL
  source 1..101: mol_type = other RNA
agaaaaaaaaaaaaaaaaaaaaaaaaaaaaaaaaaaaaaaaaaaaaaaaaaaaaaaaaaaaaaaaaaaaaaaaaaaacaaaggctcttttcagagccacca

SEQ ID NO: 17527 - RNA, 99 nt, synthetic construct
  misc_feature 1..99: note = mRNA 3'-end histoneSL-A75
  source 1..99: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaa

SEQ ID NO: 17528 - RNA, 124 nt, synthetic construct
  misc_feature 1..124: note = mRNA 3'-end histoneSL-A100
  source 1..124: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 17529 - RNA, 170 nt, synthetic construct
  misc_feature 1..170: note = mRNA 3'-end histoneSL-A146
  source 1..170: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 17530 - RNA, 136 nt, synthetic construct
  misc_feature 1..136: note = mRNA 3'-end N8-A64-N5-C30-histoneSL-N5
  source 1..136: mol_type = other RNA
agattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17531 - RNA, 131 nt, synthetic construct
  misc_feature 1..131: note = mRNA 3'-end N8-A64-N5-C30-histoneSL
  source 1..131: mol_type = other RNA
agattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 17532 - RNA, 105 nt, synthetic construct
  misc_feature 1..105: note = mRNA 3'-end N8-A64-N5-C4-histoneSL
  source 1..105: mol_type = other RNA
agattaataaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 17533 - RNA, 115 nt, synthetic construct
  misc_feature 1..115: note = mRNA 3'-end N8-A64-N5-C14-histoneSL
  source 1..115: mol_type = other RNA
agattaataaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 17534 - RNA, 134 nt, synthetic construct
  misc_feature 1..134: note = mRNA 3'-end N6-A64-N5-C30-histoneSL-N5
  source 1..134: mol_type = other RNA
agatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17535 - RNA, 129 nt, synthetic construct
  misc_feature 1..129: note = mRNA 3'-end N6-A64-N5-C30-histoneSL
  source 1..129: mol_type = other RNA
agatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 17536 - RNA, 103 nt, synthetic construct
  misc_feature 1..103: note = mRNA 3'-end N6-A64-N5-C4-histoneSL
  source 1..103: mol_type = other RNA
agatctaaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 17537 - RNA, 113 nt, synthetic construct
  misc_feature 1..113: note = mRNA 3'-end N6-A64-N5-C14-histoneSL
  source 1..113: mol_type = other RNA
agatctaaaaaaaaaaaaaaaaaaaaaaaaaaaaaaaaaaaaaaaaaaaaaaaaaaaaaaaaaaaaaaaatgcatcccccccccccccccaaaggctcttttcagagccacca

SEQ ID NO: 17538 - RNA, 128 nt, synthetic construct
  misc_feature 1..128: note = mRNA 3'-end A64-N5-C30-histoneSL-N5
  source 1..128: mol_type = other RNA
aaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 17539 - RNA, 123 nt, synthetic construct
  misc_feature 1..123: note = mRNA 3'-end A64-N5-C30-histoneSL
  source 1..123: mol_type = other RNA
aaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccacca

SEQ ID NO: 17540 - RNA, 97 nt, synthetic construct
  misc_feature 1..97: note = mRNA 3'-end A64-N5-C4-histoneSL
  source 1..97: mol_type = other RNA
aaaaaaaaaaaaaaaaaaaaaaaaaaaaaaaaaaaaaaaaaaaaaaaaaaaaaaaaaaaaaaaatgcatcccccaaaggctcttttcagagccacca

SEQ ID NO: 17541 - RNA, 107 nt, synthetic construct
  misc_feature 1..107: note = mRNA 3'-end A64-N5-C14-histoneSL
  source 1..107: mol_type = other RNA
aaaaaaaaaaaaaaaaaaaaaaaaaaaaaaaaaaaaaaaaaaaaaaaaaaaaaaaaaaaaaaaatgcatcccccccccccccccaaaggctcttttcagagccacca
